US009399059B2

(12) United States Patent
Morrison

(10) Patent No.: US 9,399,059 B2
(45) Date of Patent: Jul. 26, 2016

(54) VIRUS-LIKE PARTICLES AS VACCINES FOR PARAMYXOVIRUS

(75) Inventor: Trudy Morrison, Northborough, MA (US)

(73) Assignee: University of Massachusetts, Boston, MA (US)

( * ) Notice: Subject to any disclaimer, the term of this patent is extended or adjusted under 35 U.S.C. 154(b) by 738 days.

(21) Appl. No.: 12/012,175

(22) Filed: Jan. 31, 2008

(65) Prior Publication Data

US 2009/0068221 A1    Mar. 12, 2009

Related U.S. Application Data

(63) Continuation-in-part of application No. 11/497,888, filed on Aug. 2, 2006, now Pat. No. 7,951,384.

(60) Provisional application No. 60/706,126, filed on Aug. 5, 2005.

(51) Int. Cl.

| | | |
|---|---|---|
| *C12N 7/04* | (2006.01) | |
| *A61K 39/12* | (2006.01) | |
| *A61K 39/17* | (2006.01) | |
| *C12N 7/00* | (2006.01) | |
| *A61K 39/00* | (2006.01) | |

(52) U.S. Cl.

CPC ............... *A61K 39/17* (2013.01); *A61K 39/12* (2013.01); *C12N 7/00* (2013.01); *A61K 2039/5256* (2013.01); *A61K 2039/5258* (2013.01); *A61K 2039/6081* (2013.01); *C07K 2319/00* (2013.01); *C07K 2319/03* (2013.01); *C12N 2710/14143* (2013.01); *C12N 2760/18123* (2013.01); *C12N 2760/18134* (2013.01); *C12N 2760/18423* (2013.01); *C12N 2760/18523* (2013.01); *C12N 2760/18623* (2013.01)

(58) Field of Classification Search
None
See application file for complete search history.

(56) References Cited

U.S. PATENT DOCUMENTS

| | | | |
|---|---|---|---|
| 4,774,339 A | 9/1988 | Haugland et al. ............. 548/405 |
| 5,098,825 A | 3/1992 | Tchen et al. ...................... 435/6 |
| 5,187,288 A | 2/1993 | Kang et al. ..................... 548/110 |
| 5,248,782 A | 9/1993 | Haugland et al. ............. 548/110 |
| 5,250,431 A | 10/1993 | Rudd et al. ................. 435/240.2 |
| 5,274,113 A | 12/1993 | Kang et al. ..................... 548/405 |
| 5,344,760 A | 9/1994 | Harvey et al. .................. 435/7.5 |
| 5,348,867 A | 9/1994 | Georgiou et al. ............. 435/69.7 |
| 5,433,896 A | 7/1995 | Kang et al. ..................... 252/700 |
| 5,451,663 A | 9/1995 | Kang et al. ..................... 530/367 |
| 5,583,816 A | 12/1996 | McClure ......................... 365/201 |
| 5,589,372 A | 12/1996 | Robinson ....................... 435/193 |
| 5,674,753 A | 10/1997 | Harvey ........................... 436/501 |
| 5,690,938 A | 11/1997 | Ermak et al. ................. 424/215.1 |
| 5,804,196 A | 9/1998 | Mazzara et al. ............ 424/208.1 |
| 5,847,096 A | 12/1998 | Schubert ........................ 536/23.4 |
| 5,851,993 A | 12/1998 | Jalkanen et al. ................. 514/12 |
| 5,916,879 A | 6/1999 | Webster .......................... 514/44 |
| 5,985,641 A | 11/1999 | Haynes et al. ................. 435/236 |
| 6,013,772 A | 1/2000 | Barnett et al. ............. 530/387.7 |
| 6,140,059 A | 10/2000 | Schawaller .................... 435/7.1 |
| 6,248,327 B1 | 6/2001 | Daniel et al. .............. 424/143.1 |
| 6,291,659 B1 | 9/2001 | Carosella et al. ............. 536/23.1 |
| 6,328,972 B1 | 12/2001 | Rock .......................... 424/196.11 |
| 6,342,228 B1 | 1/2002 | Rovinski et al. ............ 424/199.1 |
| 6,387,662 B1 | 5/2002 | Liang et al. ................... 435/69.3 |
| 6,417,341 B1 | 7/2002 | Anders et al. ................ 536/23.5 |
| 6,423,316 B1 | 7/2002 | Riesbeck et al. ............. 424/192.1 |
| 6,531,295 B1 | 3/2003 | Saunder ........................ 435/69.1 |
| 6,544,527 B1 | 4/2003 | Rovinski et al. ............ 424/208.1 |
| 6,566,074 B1 | 5/2003 | Goefinck ........................ 435/7.1 |
| 6,602,705 B1 | 8/2003 | Barnett et al. ............. 435/320.1 |
| 6,689,367 B1 | 2/2004 | Collins et al. ............... 424/211.1 |
| 6,695,545 B2 | 2/2004 | Boston ......................... 405/302.4 |
| 6,699,476 B1 | 3/2004 | Collins et al. ............... 424/199.1 |
| 6,713,066 B1 | 3/2004 | Collins et al. ............... 424/199.1 |
| 6,719,979 B2 | 4/2004 | Peeters et al. ............... 424/214.1 |
| 6,875,592 B2 | 4/2005 | Rothschild et al. ........... 435/91.1 |
| 6,875,853 B2 | 4/2005 | Potter et al. ................... 536/23.4 |
| 6,900,035 B2 | 5/2005 | Mizzen et al. ............... 435/69.7 |
| 6,913,881 B1 | 7/2005 | Aizenstein et al. ............. 435/6 |
| 6,930,181 B1 | 8/2005 | Pietropaolo et al. .......... 536/23.5 |
| 6,939,952 B2 | 9/2005 | Zhao ............................ 530/350 |
| 6,942,866 B2 | 9/2005 | Birkett ........................ 424/268.1 |
| 6,946,543 B2 | 9/2005 | Ward et al. ................... 530/350 |
| 6,991,797 B2 | 1/2006 | Andersen et al. ............. 424/248 |
| 7,005,254 B2 | 2/2006 | Demo et al. ....................... 435/4 |
| 7,018,637 B2 | 3/2006 | Chong et al. .............. 424/197.11 |
| 7,022,324 B2 | 4/2006 | Binley et al. .............. 424/188.1 |
| 7,029,685 B2 | 4/2006 | Lanar et al. ................ 424/272.1 |
| 7,037,510 B2 | 5/2006 | Andersen et al. ........... 424/248.1 |
| 7,060,276 B2 | 6/2006 | Lanar et al. ................ 424/184.1 |
| 7,067,110 B1 | 6/2006 | Gillies et al. ................. 424/1.49 |

(Continued)

OTHER PUBLICATIONS

Madea et al., Mircobiol Immunol 1978, vol. 22, pp. 275-284.*
Seal, Bruce S. et al., Developmental and Comparative Immunology 24 (2000) 257-268, *The avian response to Newcastle disease virus*.
Sugahara, Fumihiro et al., Virology 325 (2004) 1-10, *Paramyxovirus Sendai virus-like particle formation by expression of multiple viral proteins and acceleration of its release by C protein*.
Bernsel et al., "Improved membrane protein topology prediction by domain assignments," *Protein Science* 14:1723-1728 (2005).
Elofsson et al., "Membrane protein structure: prediction versus reality" *Annu. Rev. Biochem.* 76:125-140 (2007).

(Continued)

*Primary Examiner* — Shanon A Foley
*Assistant Examiner* — Myron Hill
(74) *Attorney, Agent, or Firm* — Medlen & Carroll, LLP

(57) ABSTRACT

The invention provides expression vectors and virus-like particles (VLPs) containing Newcastle Disease Virus Sequences in combination with sequences encoding proteins of interest. The vectors are useful in, for example, generating virus-like particles (VLPs) that contain proteins of interest. In one embodiment, the expressed VLPs elicit an immune response by an animal host against the protein. The invention's VLPs are useful as, for example, vaccines.

23 Claims, 259 Drawing Sheets
(1 of 259 Drawing Sheet(s) Filed in Color)

(56) References Cited

U.S. PATENT DOCUMENTS

| | | | | |
|---|---|---|---|---|
| 7,101,566 | B2 | 9/2006 | Rosenblatt et al. | 424/423 |
| 7,105,488 | B1 | 9/2006 | Tarasova et al. | 514/16 |
| 7,119,165 | B2 | 10/2006 | Strittmatter | 530/350 |
| 7,122,347 | B2 | 10/2006 | Verheije et al. | 435/69.1 |
| 7,153,659 | B2 | 12/2006 | Harding et al. | 435/6 |
| 7,166,291 | B2 | 1/2007 | Morgenstern et al. | 425/275.1 |
| 7,189,403 | B2 | 3/2007 | Despres et al. | 424/218.1 |
| 7,217,526 | B2 | 5/2007 | Terajima et al. | 435/7.1 |
| 7,220,420 | B2 | 5/2007 | Chisari et al. | 424/228.1 |
| 7,223,390 | B2 | 5/2007 | Brown | 424/93.2 |
| 7,238,356 | B2 | 7/2007 | Bosman et al. | 424/228.1 |
| 7,250,171 | B1 | 7/2007 | Tao et al. | 424/211.1 |
| 7,253,254 | B1 | 8/2007 | Sebald | 530/300 |
| 7,262,270 | B2 | 8/2007 | Weissenhorn et al. | 530/324 |
| 7,297,337 | B2 | 11/2007 | Storkus et al. | 424/185.1 |
| 2003/0224017 | A1 | 12/2003 | Samal et al. | 424/214.1 |
| 2004/0009193 | A1 | 1/2004 | Morikawa | 424/208.1 |
| 2004/0105871 | A1 | 6/2004 | Robinson et al. | 424/199.1 |
| 2005/0002953 | A1 | 1/2005 | Herold | 424/186.1 |
| 2010/0247574 | A1* | 9/2010 | Mahmood et al. | 424/214.1 |

OTHER PUBLICATIONS

Graham et al., "Characteristics of a human cell line transformed by DNA from himan adenovirus type 5," *J. Gen. Virol.* 36:59-72 (1977).

Haffar et al., "Human immunodeficiency virus-like, nonreplicating, gag-env particles assemble ina recombinant vaccinia virus expression system," *J. Gen. Virol.* 64:2653-2659 (1990).

Hagensee et al., "Self-assembly of human papillomavirus type 1 capsids by expression of the 11 protein alone or by coexpression of the 11 and 12 capsid proteins," *J. Gen. Virol.* 67:315-322 (1993).

High et al., "Sec61p is adjacent to nascent type 1 and type ii signal-anchor proteins during their membrane insertion" *J. Cell Biol.* 121:743-750.

Kimbauer et al., "Papillomavirus 11 major capsid protein self-assembles into virus-like particles that are highly immunogenic,"*PNAS* 89:12180-12184 (1992).

Mather et al., "Culture of testicular cells in hormone-supplemented serum-free medium," *Annal. NY Acad. Sci.* 383:44-62 (1982).

Mather et al., "Establishment and characterization of two distinct mouse testicular epithelial cell lines," *Biology of Reproduction* 23:243-252 (1980).

McGinnes et al, "Inhibition of receptor binding stabilizes newcastle disease virus hn and f protein-containing complexes," *J. Gen. Virol.* 80:2894-2903 (2006).

Alexander D.J., "Newcastle disease, other avian paramyxoviruses, and pneumovirus infections,"In *Diseases of Poultry*, Barnes et al. Editors 11th Ed., Ch. 2, pp. 63-99 (2003)

Ali et al., Assembly of Sendai virus: M protein interacts with F and HN proteins and with the cytoplasmic tail and transmembrane domain of F protein *Virology* 276:289-303 (2000).

Aslanidis et aL, "Ligation-independent cloning of PCR products (LIC-PCR)" *Nucleic Acids Res.* 18:6069-6074 (1990).

Babst et al., "ESCRT-III: an endosome-associated heterooligomeric protein complex required for MVB sorting" *Dev Cell* 3:271-282 (2002).

Belyaev et al., "High-level expression of five foreign genes by a single recombinant baculovirus," *Gene* 156:229-233 (1995).

Belyaev et al., "Development of baculovirus triple and quadruple expression vectors: co-expression of three or four bluetongue virus proteins and the synthesis of blue tongue virus-like particles in insect cells," *Nucleic Acids Res.* 21:1219-1223 (1993).

Bieniasz, P. D., "Late budding domains and host proteins in enveloped virus release" *Virology* 344:55-63 (2006).

Boublik et al., "Eukary virus diaplay: engineering the major surface glycoprotein of the *Autographa californica* nuclear polyhedrosis virus (AcNPV) for the presentation of foreign proteins on the virus surface," *Bio/Technology* 13:1079-1084 (1995).

Carter, C. A., "Tsg101: HIV-1's ticket to ride," *Trends Microbiol.* 10:203-205 (2002).

Cathomen et al., "A matrix-less measles virus is infectious and elicits extensive cell fusion: consequences for propagation in the brain," *EMBO J.* 17:3899-3908 (1998).

Chanock et al, Parainfluenza Viruses, in Fields Virology, Ed. Knipe, D. and Howley, P. Lippincott Williams and Wilkins, Chapter 42, pp. 1341-1379 (2001).

Chen et al., "Functions of early (AP-2) and late (AIP1/ALIX) endocytic proteins in equine infectious anemia virus budding," *J Biol Chem*, 280:40474-40480 (2005).

Chubet et al., "Vectors for expression and secretion of FLAG epitope-tagged proteins in mammalian cells" *Biotechniques* 20:136-41 (1996).

Collins, et al, Respiratory Syncytial Virus, in Fields Virology, Ed. Knipe, D. and Howley, P. Lippincott Williams and Wilkins, 2001, pp. 1443.

Coronel et al., "Human parainfluenza virus type 1 matrix and nucleoprotein genes transiently expressed in 12 mammalian cells induce the release of virus-like particles containing 13 nucleocapsid-like structures," *J. Virol.* 73:7035-8 (1999).

Delchambre et al., "The GAG precursor of simian immunodeficiency virus assembles into virus-like particles," *EMBO J* 8:2653-60 (1989).

Demirov et al., "Retrovirus budding," *Virus Res* 106:87-102 (2004).

DiCesare et al., "A high-sensitivity electrochemiluminescence-based detection system for automated PCR product quantitation," *BioTechniques* 15:152-59 (1993).

Dolganiue et al., "Role the cytoplasmic domain of the Newcastle disease virus fusion protein in association with lipid rafts," *J Virol* 77:12968-12979 (2003).

Duck et al., "Probe amplifier system based on chimeric cycling oligonucleotides," *BioTech.*, 9:142-147 (1990).

Faeberg et al., "Strain variation and nuclear association of 20 NDV matrix protein," *J Virol.* 62:586-593 (1988).

Fouillot-Coriou et al., "Structure-Function Analysis of the Sendai Virus F and HN Cytoplasmic Domain: Different Role for the Two Proteins in the Production of Virus Particle," *Virology.* 270: 464-475 (2000).

Freed, E. O., "Mechanisms of enveloped virus release," Virus Res 106:85-86 (2004).

Freed, E. O., "Viral late domains," *J. Virol.* 76:4679-87 (2002).

Freed, E. O., "The HIV-TSGI01 interface: recent advances in a budding field," *Trends Microbiol.* 11:56-9 (2003).

Gallili et al., "Newcastle disease vaccines" *Biotechnology Advances* 16:343-366 (1998).

Garoff et al., "Virus Maturation by Budding," *Microbiol Mol Biol Rev* 62:1171-1190 (1998).

Garrus et al., "Tsg101 and the vacuolar protein sorting pathway are essential for HIV-1 budding," *Cell* 107:55-65 (2001).

Gheysen et al., "Assembly and release of HIV-1 precursor Pr$^{gag}$ virus-like particles from recombinant baculovirus-infected insect cells," *Cell* 59:103-12 (1989).

Ghildyal et al., "Interaction between the respiratory syncytial virus G glycoprotein cytoplasmic domain and the matrix protein," *J Gen Virol* 86:1879-1884 (2005).

Gomez-Puertas et al., "Influenza virus matrix protein is the major driving force in virus budding," *J. Virol.*74:11538-47 (2000).

Gonzalez-Reyes, et al, "Cleavage of the human respiratory syncytial virus fusion protein at two distinct sites is required for activation of membrane fusion," PNAS 98:9859-9864 (2001).

Greenberg et al., "Immunization against viral respiratory disease: A review," *Pediatr Infect Dis J.* 23(11):S254-61 (2004).

Henderson et al., "Sorting of the respiratory syncytial virus matrix protein into detergent-resistant structures is dependent on cell-surface expression of the glycoproteins," *Virology* 300:244-254 (2002).

Herbst et al., "HAM: a new epitope-tag for in vivo protein labeling," *Mol Biol Rep.* 27:203-8 (2000).

Huang et al., "p6$^{Gag}$ is required for particle production from full-length human immunodeficiency virus type I molecular clones expressing protease," *J Virol* 69:6810-6818 (1995).

Huang et al., "Recombinant newcastle disease as a vaccine vector," *Poultry Sciences* 82:899-906 (2003).

Inoue et al., "A new Sendai virus vector deficient in the matrix gene does not form virus particles and shows extensive cell-to-cell spreading," *J. Virol.* 77:6419-29 (2003).

(56) References Cited

OTHER PUBLICATIONS

Irie et al., "Budding of PPxY-containing rhabdoviruses is not dependent on host proteins TGS101 and VPS4A," *J Virol* 78:2657-2665 (2004).
Jasenosky et al., "Ebola virus VP40-induced particle formation and association with the lipid bilayer," *J. Virol.* 75:5205-14 (2001).
Jasenosky et al., "Filovirus budding," *Virus Res.* 106:181-188 (2004).
Jayakar et al., "Rhabdovirus assembly and budding," *Virus Res.* 106:117-32 (2004).
Jiang et al., "Multivesicular bodies: a mechanism to package lytic and storage functions in one organelle?," *Trends Cell Biol.* 12:362-7 (2002).
Katzmann et al., "Ubiquitin-dependent sorting into the multivesicular body pathway requires the function of a conserved endosomal protein sorting complex, ESCRT-I," *Cell* 106:145-55 (2001).
Katzmann et al., "Vps27 recruits ESCRT machinery to endosomes during MVB sorting," *J Cell Biol.* 162:413-23 (2003).
Kennedy et al., "Measles virus infection and vaccination: potential role in chronic illness and associated adverse events," *Crit Rev Immunol.* 24(2):129-56 (2004).
Kho et al., "Regions on nucleocapsid protein on newcastle disease that interact with its phosphoprotein," *Archives of virology* 149:997-1005 (2004).
Kitts et al., "A method for producing recombinant baculovirus expression vectors at high frequency," *BioTechniques* 14:810-817 (1993).
Lamb et al., "Paramyxoviridae: The Viruses and Their Replication" Chapter 41, pp. 1305-1340. In: *Fields Virology, Third Edition*, vol. 1., Eds: D. M. K. &. P. M. Howley, LippincottWilliams & Wilkins, Philadelphia (2001).
Levinson et al., "Radiation studies of avian tumor viruses and Newcastle disease virus," *Virology* 28:533-542 (1966).
Li et al., "Effect of cleavage mutants on syncytium formation directed by the wild-type fusion protein of Newcastle disease virus," *J. Virol.* 72:3789-95 (1998).
Li et al., "Viral liposomes released from insect cells infected with recombinant baculovirus expressing the matrix protein of vesicular stomatitis virus," *J. Virol.* 67:4415-20 (1993).
Li et al., "Mumps Virus Matrix, Fusion, and Nucleocapsid Proteins Cooperate for Efficient Production of Virus-Like Particles," *J. Virol.* 1-37 (2009).
Maeda et al., "Isolation and characterization of defective interfering particle of newcastle disease virus," *Microbiol Immunol.* 22(12):775-84 Astract only (1978).
Martindale, D., "Budding viral hijackers co-opt the endocytic machinery to make a getaway," *J Biol.* 3:2-2.5 (2003).
Martin-Serrano et al., "Role of ESCRT-I in retroviral budding," *J. Virol* 77:4794-4804 (2003).
McGinnes et al., "Newcastle disease virus HN protein alters the conformation of the F protein at cell surfaces," *J. Virol.* 76:12622-33 (2002).
McGinnes et al., "Role of carbohydrate processing and calnexin binding in the folding and activity of the HN protein of Newcastle disease virus," *Virus Res* 53:175-85 (1998).
Mebatsion et al., "Matrix protein of rabies virus is responsible for the assembly and budding of bullet-shaped particles and interacts with the transmembrane spike glycoprotein G," *J. Virol.* 73:242-50 (1999).
Miyazaki et al., "Expression vector system based on the chicken beta-actin promoter directs efficient production of interleukin-5," *Gene* 79:269-77 (1989).
Morita et al., "Retrovirus budding," *Annu Rev Cell Dev Biol* 20:395-425 (2004).
Nagy et al., "Synthesis of newcastle disease virus (NDV)-like envelopes in insect cells infected with a recombinant baculovirus expressing the haemagglutinin-neuraminidase of NDV," *J Gen Virol.* 72:753-756 (1991).
Nayak et al., "Assembly and budding of influenza virus," *Virus Res* 106:147-65 (2004).

Niwa et al., "Efficient selection for high-expression transfectants with a novel eukaryotic vector," *Gene* 108:193-9 (1991).
Noad et al., "Virus-like particles as immunogens," *Trends Microbiol* 11:438-444 (2003).
Ong et al., "Cloning and expression of the HN gene from the velogenic viscerotropic newcastle disease virus strain AF2240 in Sf9 insect cells," *Cytotechnology* 32:243-251 (2000).
Panch et al., "In vivo oligomerization and raft localization of Ebola virus protein VP40 during vesicular budding," *PNAS, USA* 100:15936-41 (2003).
Pantua et al., "Requirements for the Assembly and Release of Newcastle Disease Virus-Like Particles" *J. Virology.* 80:11062-11073 (2006).
Patterson et al., "Evidence that the hypermutated M protein of a subacute sclerosing panencephalitis measles virus actively contributes to the chronic progressive CNS disease," *Virology*, 291:215-25 (2001).
Peeples M. E., "Paramyxovirus M proteins: pulling it all together and taking it on the road," Chapter 16, pp. 427-456 In: *The Paramyxoviruses*, Ed: D. W. Kingsbury, Plenum, New York, N.Y (1991).
Pornillos et al., "Mechanisms of enveloped RNA virus budding," *Trends Cell Biol.* 12:569-79 (2002).
Pornillos et al., "HIV Gag mimics the Tsg101-recruiting activity of the human Hrs protein," *J Cell Biol* 162:425-34 (2003).
Puffer et al., "Equine infectious anemia virus utilizes a YXXL motif within the late assembly domain of the Gag p9 protein," *J Virol* 71:6541-6546 (1997).
Raiborg et al., "Protein sorting into multivesicular endosomes," *Cuff Opin Cell Biol* 15:446-55 (2003).
Richards et al., *In: The Enzymes,*, bovine pancreatic ribonuclease,vol. IV (Boyer, P.D., Ed.), Ch. 24, pp. 647-806, Academic Press, New York (1971).
Sakaguchi et al., "Double-layered membrane vesicles released from mammalian cells infected with Sendai virus expressing the matrix protein of vesicular stomatitis virus," *Virology* 263:230-43 (1999).
Sanderson et al., "Sendai virus assembly:M protein binds to viral glycoproteins in transit through the secretory pathway," *J Virol* 67:651-663 (1993).
Schmitt et al., "Escaping from the cell: assembly and budding of negative-strand RNA viruses," *Cuff Top Microbiol Immunol* 283:145-96 (2004).
Schmitt et al., "Evidence for a new viral late-domain core sequence, FPIV, necessary for budding of a paramyxovirus," *J. Virol.* 79:2988-97 (2005).
Schmitt et al., "Requirements for budding of paramyxovirus simian virus 5 virus-like particles," *J Virol* 76:3952-64 (2002).
Seal et al., "The avian response to newcastle disease virus," *Dev. Comparative Immunology* 24:257-268 (2000).
Sheshberadaean et al, "Sequence characterization of the membrane protein gene of paramyxovirus simian virus 5", *Virology* 176:234-243 (1990).
Simons et al., "The budding mechanisms of enveloped animal viruses," *J. Gen. Virol.* 50:1-21 (1980).
Strack et al., "A1P1/ALIX is a binding partner for HIV-1 p6 and EIAV p9 functioning in virus budding," *Cell* 114:689-699 (2003).
Stricker et al., "The Sendai virus matrix protein appears to be recruited in the cytoplasm by the viral nucleocapsid to function in viral assembly and budding," *J Gen Virol* 75 ( Pt 5):1031-1042 (1994).
Sugahara et al., "Paramyxovirus Sendai virus-like particle formation by expression of multiple viral proteins and acceleration of its release by C protein," *Virology* 325:1-10 (2004).
Takimoto et al., "Molecular mechanism of paramyxovirus budding," *Virus Res.* 106:133-45 (2004).
Takimoto et al., "Role of matrix and fusion proteins in budding of Sendai virus," *J. Virol.* 75: 11384-91 (2001).
Teng et al., "Identification of the Respiratory Syncytial Virus Proteins Required for Formation and Passage of Helper-Dependent Infectious Particles," *J. Virology.* 72: 5707-5716 (1998).

(56) References Cited

OTHER PUBLICATIONS

Terpe K., "Overview of tag protein fusions: from molecular and biochemical fundamentals to commercial systems," *Appl Microbiol Biotechnol.* 60:523-33 (2003).

Timmins et al., "Vesicular release of Ebola virus matrix protein VP40," *Virology* 283: 1-6 (2001).

Urdea et al., "A novel method for the rapid detection of specific nucleotide sequences in crude biological samples without blotting or radioactivity; application to the analysis of hepatitis B virus in human serum," *Gene* 61:253-264 (1987).

Vana et al., "Role of Nedd4 and ubiquitination of rous sarcoma virus Gag in budding of virus-like particles from cells," *J Virol* 78:13943-13953 (2004).

Varshney et al., "Direct analysis of aminoacylation levels of tRNA in vitro," *J. Biol. Chem.* 266:24712-24718 (1991).

Vincent, et al., "Inefficient measles virus budding in murine L.CD46," *Virology* 265:185-195 (1999).

von Schwedler et al., "The protein network of HIV budding," *Cell* 114:701-13 (2003).

Weyer et al., "A baculovirus dual expression vector derived from the autographa californica nuclear polyhedrosis virus polyhedrin and p10 promoters: co-expression of two influenza virus genes in insect cells," *J. Gen. Virol.* 72:2967-2974 (1991).

Willenbrink et al., "Long-term replication of sendai virus defective interfering particle nucleocapsids in stable helper cell lines," *J. Virol.* 68:8413-8417 (1994).

Wunderlich et al., "Use of recombinant fusion proteins for generation and rapid characterization of monoclonal antibodies," *J. Immunol. Methods* 147:1-11 (1992.

Xiang et al., "Fine mapping and characterization of the rous sarcoma virus Pr76$^{gag}$ late assembly domain," *J Virol* 70:5695-5700 (1996).

Yoshida et al., "Membrane (M) protein of HVJ (sendai virus): Its role in virus assembly" *Virology* 71:143-161 (1976).

Buynak, et al., "Vaccine against Human Hepatitis B." *Jama*, 235(26):2832-2834 (1976).

Coates, et al., "Hepatitis B Vaccines: Assessment of the Seroprotective Efficacy of Two Recombinant DNA Vaccines." *Clin Ther*, 23(3):392-403 (2001).

Jennings and Bachmann, "The Coming of Age of Virus-Like Particle Vaccines." *Biol Chem*, 389(5):521-536 (2008).

Harro, et al., "Safety and Immunogenicity Trial in Adult Volunteers of a Human Papillomavirus 16 L1 Virus-Like Particle Vaccine." *J Natl Cancer Inst*, 93(4):284-292 (2001).

Warfield, et al., "Ebola Virus-Like Particles Protect from Lethal Ebola Virus Infection." *Proc Natl Acad Sci USA*, 100(26):15889-15894 (2003).

\* cited by examiner

MSSVFDEYEQLLAAQTRPNGTHGGGEKGSTLKVEVPVFTLNSDD
PEDRWNFAVFCLRIAVSEDANKPLRQGALISLLCSHSQVMRNHVALAGKQNEATLAVL
EIDSFADSVPQFNNRSGVSEERAQRFMVIAGSLPRACSNGTPFVTAGVEDDAPEDITD
TLERILSIQAQVWVTVAKAMTAYETADESETRRINKYMQQGRVQKKYILHPVCRSAIQ
LTIRHSLAVRIFLVSELKRGRNTAGGSSTYYNLVGDVDSYIRNTGLTAFFLTLKYGIN
TKTSALALSSLTGDIQKMKQLMRLYRMKGENAPYMTLLGDSDQMSFAPAEYAQLYSFA
MGMASVLDKGTGKYQFARDFMSTSFWRLGVEYAQAQGSSINEDMAAELKLNPAARRGL
AAAAQRVSEEIGNMDIPTQQAGVLTGLSDKGPRAPQGGPSRSQGQPDAGDGETQFLDL
MRAVANSMREAPNSAQSTIHPEPLPTHGPSQDNDTDWGY

FIG. 8A

```
   1 atgtcgtccg tatttgacga atacgagcag ctcctcgctg ctcagacccg ccctaacgga
  61 actcatggag ggggagagaa agggagcact ttaaaagttg aggtcccagt atttacccett
 121 aacagtgatg atccagagga tagatggaat tttgcggtat tctgtcttcg gattgctgtt
 181 agcgaggatg ccaacaaacc actcaggcaa ggtgctctta tatccctctt atgctcccat
 241 tctcaggtga tgagaaacca cgttgccctt gcagggaaac agaatgaggc tacactggct
 301 gttcttgaga tcgatagttt tgccgacagt gtgccccagt tcaacaatag gagtggagtg
 361 tctgaggaaa gagcacagag attcatggta atagcaggat ctctccctcg ggcatgcagc
 421 aacggtactc cgttcgtcac agctggggtt gaagatgatg caccagaaga tatcactgac
 481 actctggaaa gaatcctatc tatccaggct caggtatggg tcacagtagc aaaggccatg
 541 actgcatatg agacagcaga tgagtcggaa acaagaagaa taaataagta tatgcagcaa
 601 ggtagagtcc agaagaaata catccttcac cctgtatgca ggagtgcaat tcaactcaca
 661 atcagacatt ctctggcagt ccgtatttc ctagttagtg agctcaagag gggccgcaat
 721 acagcaggtg ggagctccac atattacaac ttggtcgggg atgtagactc atacatcaga
 781 aacaccgggc ttactgcatt tttcctaaca ctcaaatatg gaatcaatac caagacgtca
 841 gccctcgcac tcagcagcct cacaggtgat atccaaaaaa tgaaacagct catgcgttta
 901 tatcggatga aaggtgaaaa tgcaccatac atgacattgt taggtgacag tgaccagatg
 961 agctttgcac cagctgagta tgcacaactt tattcttttg ccatgggcat ggcatcagtc
1021 ttagataagg gaactggcaa ataccaattc gccagagact tcatgagcac atcattctgg
1081 agactcgggg tggagtatgc tcaggctcag ggaagtagca tcaatgaaga tatggctgct
1141 gaattgaaac ttaacccagc agcaaggagg ggcctggcag ctgctgccca acgagtatct
1201 gaggaaattg gcaacatgga tattcctact caacaggccg gggtccttac tgggctcagc
1261 gacaaaggtc cccgagctcc acagggtgga ccgagcaggt cgcaagggca accggacgcc
1321 ggggatgggg agacccaatt cctggatctg atgagagcag tggcaaacag catgcgagaa
1381 gcgccaaatt ctgcacagag caccattcac ccggagcctc tcccaactca tgggccatct
1441 caagacaacg acaccgactg ggggtactga
```

FIG. 8B

MDRVVSRVVLENEEREAKNTWRLVFRIAVLSLVVMTLAISVATL
VYSMEASTPGDLAGISTVISKAEDKVISLLSSNQDVVDRVYKQVALESPLALLNTESV
IMNAITSLSYQINGAANNSGCGAPVHDPDYVGGVGKELIVDDTSDVTSFYPSAYQEHL
NFIPAPTTGSGCTRIPSFDMSATHYCYTHNVILSGCRDHSHSHQYLALGVLRTSATGR
VFFSTLRSINLDDTQNRKSCSVSATPLGCDMLCSKVTEIEEEDYKSATPTSMVHGRLG
FDGQYHEKDLDVTALFKDWVANYPGVGGGSLIGDRVWFPVYGGLKPNSPSDIAQEGRY
VIYKRYNNTCPDEQDYQVRMAKSSYKPGRFGGKRVQQAILSIKVSVSLGEDPVLTVPP
NTVTLMGAEGRVLTVGTSHFLYQRGSSYFSPALLYPMTIHNKTATLHSPYTFNAFTRP
GSVPCQASARCPNSCITGVYTDPYPVVFHKNHTLRGVFGTMLDNEQARFNPVSAVFDY
TSRSRITRVSSSSTKAAYTTSTCFKVVKTNKIYCLSIAEISNTLFGEFRIVPLLVEIL
KDDRV

FIG. 9A

```
   1 acgggtagaa cggtgggaga ggccacccct tagtggggaa ccaagcttct taacgtccgt
  61 tctaccgcat taccaatagc ataccttagt catggatcgt gtagttagta gggttgtact
 121 agagaatgag gaaagagaag caaagaacac atggcgcctg gtttttcgga tcgcagtctt
 181 atctctagta gtaatgactt tagctatctc tgttgccacc ctagtataca gcatggaggc
 241 tagcacaccg ggcgatctgg cgggcatatc gacggtgatc tctaaggcag aggataaggt
 301 gatatctcta ctcagttcaa atcaagatgt ggtagatagg gtatataaac aggtggccct
 361 tgagtcccca ctggcattgc tgaatactga gtctgtaatt atgaatgcaa taacttctct
 421 ctcctatcaa attaacggag ccgcaaataa tagtgggtgt ggggcacctg ttcatgaccc
 481 agattacgtt gggggagtag gcaaagagct catagtagat gacacaagtg atgtcacatc
 541 attctaccct tcagcatacc aagaacacct gaattttatc ccggcgccta ctacaggatc
 601 aggctgcact cggataccct cgttcgacat gagcgctacc cattattgtt atactcacaa
 661 tgtaatatta tctggttgca gagatcactc acactcacat cagtatttag cactaggtgt
 721 acttcggaca tctgcaacag ggagggtatt ctttctact ctgcgctcca tcaatttgga
 781 tgacacccaa aatcggaagt cttgcagtgt gagtgcgact cctttaggtt gtgatatgct
 841 gtgctctaaa gtcacagara ttgaagagga ggattataag tcagctactc ccacatcaat
 901 ggtgcatgga aggttaggrt ttgacggtca gtatcatgag aaggacttag acgtcacagc
 961 cttatttaag gattgggttg caaattatcc aggagtggga ggagggtctc ttattggcga
1021 ccgtgtatgg ttcccagttt atggagggct taaacccaat tcgcctagtg acattgcaca
1081 agaggggaga tatgtaatat ataagcgcta taataacaca tgccccgatg aacaggatta
1141 ccaagttcgg atggctaagt cttcatataa gcctggacgg tttggtggaa agcgcgtaca
1201 gcaagccatc ttatctatca aagtatcagt atctttgggc gaggacccgg tgctaaccgt
1261 acccctaat acagttacac tcatggggc cgaaggcagg gtcctcacag tagggacatc
1321 tcacttcttg taccaacgag ggtcttcata cttctctccc gccttactat accctatgac
1381 aatacacaac aaaacagcta ctcttcatag tccctataca ttcaatgctt tcactcggcc
1441 aggcagtgtc ccctgccagg catcagcaag gtgccccaac tcatgcatca ctggagtcta
1501 tactgatcca tatcctgtgg tctttcataa gaatcacacc ctgcgagggg tattcgggac
1561 gatgcttgat aatgaacaag caaggttcaa ccctgtatct gcagtatttg attacacatc
1621 tcgcagtcgc ataacccggg taagttcgag cagcaccaag gcagcataca cgacatcgac
1681 atgttttaaa gttgtcaaga ccaataaaat ttattgtctt agcattgcag aaatatccaa
1741 taccctattt ggggaattca ggattgtccc tctactggtt gagatcctca aggatgatag
1801 ggtttaagag gctaagttca gccggccggg tcaaccacga ggaagacggg aagatggcgt
1861 tgtgtcacct accctctgca atgccaagga tcaagcggaa taataatact agcccgaatc
1921 tcatgctatc agacagcctt aatcggataa tgctgacacg atcagcttga atcctgtcaa
1981 tagtcactct gtttagaaaa aatatgagag gtggtgggat ataagagaaa acaacttaca
2041 gaagatagca cgggtaggac atggcgggct ccggtcccga aagggcagag caccagatta
2101 tcctaccaga gtcacacctg
```

FIG. 9B

MGSKPSTRIPVPMMLITQIVLILSCICLTSSLDGRPLAAAGIVV
TGDKAVNIYTSSQTGSIIVKLLPNMPKDKEACAKAPLEAYNRTLTTLLTPLGDSIRRI
QGSVSTSRGRRQKRFIGAIIGSVALGVATSAQITAAAALIQANQNAANILRLKESIAA
TNEAVHEVTDGLSQLAVAVGKMQQFVNDQFNNTARELDCIKITQQVGIELNLYLTELT
TVFGPQITSPALTQLTIQALYNLAGGNMDYLLTKLGVG

FIG. 10A

```
  1 tgaggttact tctactaggt tagagaagag gcacaccatt gctaaataca atcctttcaa
 61 gaagtaagtt gcgtccctga gactgcgatc cacccacttt cctggatcat cgcaacgcaa
121 aataatgatc tgtctcgatt gcttgcagtt ggttcacctg tctatctagt tagaaaaaac
181 acgggtagaa gagtctggat cccagctggc acattcaagg tgcagtatgg gctctaaacc
241 ttctaccagg atcccagtac ctatgatgct gatcacccaa attgtgttga tactgagctg
301 tatctgtctg acaagctccc ttgacggcag gcctcttgca gctgcgggga ttgtggtaac
361 aggagataaa gcagtcaata tatacacctc atctcagacg gggtcaatca tagtcaagtt
421 gctcccaaat atgcccaagg ataaagaggc gtgtgcaaaa gccccgttag aagcatacaa
481 cagaacactg accactttac tcaccccct tggtgattcc atccgcagga tacaagggtc
541 tgtgtccaca tcaagaggaa ggagacagaa acgctttata ggtgccatta tcggcagtgt
601 agctcttggg gtcgcaacat cggcacagat aacagcagct gcggccctaa tacaagccaa
661 ccagaatgcc gccaacatcc tccggcttaa ggagagcatt gctgcaacca atgaagctgt
721 gcatgaggtc accgacggat tatcgcaact agcagtggca gttgggaaga tgcagcagtt
781 tgttaatgac caatttaata atacggcgcg agaattggac tgtatcaaaa ttacacaaca
841 agtcggtata gaactcaacc tatacctaac tgagttgact acagtgttcg ggccacaaat
901 cacttcccct gccctaactc agctgactat ccaggcactt tataatttag ctggtggcaa
961 catggattac ttgttgacta agttaggcgt agg
```

FIG. 10B

MDSSRTIGLYFDSALPSSNLLAFPIVLQDTGDGKKQFAPQYRIQ
RLDSWTDSKEDSVFITTYGFIFQVGDEEATVGMINDEPKRELLSAAMLCLGSVPNVGD
LVELARACLTMAVTCKKSATNTERMVFSVVQAPQVLQSCRVVANKYSSVNAVKHVKAP
EKIPGSGTLEYKVNFVSLTVVPRKDVYKIPTAALKVSGSSLYNLALNVTIDVEVDPKS
PLVKSLSKSDSGYYANLFLHIGLMSTVDKKGKKVTFDKLEKKIRRLDLSVGLSDVLGP
SVLVKARGARTKLMAPFFSSSGTACYPIANASPQVAKILWSQTAHLRSVKVIIQAGTQ
RAVAVTADHEATSTKLEKGHTHSKYNPFKK

FIG. 11A

```
   1 atggactcat ctaggacaat cggactgtac tttgattctg cccttccttc tagcaacttg
  61 ttagcattcc cgatcgtcct acaggacaca ggagatggaa agaagcaatt cgccccgcaa
 121 tataggatcc agcgtcttga ctcgtggacc gatagtaaag aagactcagt attcatcaca
 181 acctatggat tcatcttcca ggtcggggat gaggaagcca ctgtcggtat gatcaatgat
 241 gaacccaagc gcgagttact ttctgctgca atgctctgtc taggaagtgt cccaaacgtc
 301 ggagatctcg ttgagctggc aagggcctgt ctcaccatgg cagtcacatg caagaagagt
 361 gcaactaata ctgagaggat ggttttctca gtggtgcagg caccacaagt gctgcagagc
 421 tgcagggttg tgcaaataa atattcgtca gtgaatgctg ttaagcacgt gaaggcgcca
 481 gagaagatcc ctggaagcgg gaccctagag tacaaggtga actttgtctc cttgaccgtg
 541 gtaccgagaa aggatgtcta caagatccca accgcagcat tgaaggtttc tggttcgagt
 601 ctgtataatc ttgcgctcaa tgtcaccatt gatgtggagg tggatccgaa gagcccgttg
 661 gttaaatcgc tatctaagtc tgacagtggc tattacgcta atctcttctt gcatattgga
 721 cttatgtcca ctgtagataa gaaggggaag aaagtgacat ttgacaaatt ggaaaagaag
 781 ataaggagac ttgatctatc tgtcgggctc agtgacgtgc ttggccttc cgtgttggtg
 841 aaggcaagag gtgcacggac caaattgatg gcacctttct cctccagtag tggaacagcc
 901 tgctacccca tagcgaatgc ctctcctcag gtagccaaga tactctggag tcaaaccgcg
 961 cacctgcgga gtgtgaaagt catcatccaa gcaggcaccc aacgcgccgt cgcagtgact
1021 gctgaccacg aggctacatc caccaagctg gaaaaggggc atacccattc caaatacaat
1081 cctttcaaga aatag
```

FIG. 11B

```
   1 ttctctgtca cagaatgaaa attttttctgt catctcttcg ttattaatgt ttgtaattga
  61 ctgaatatca acgcttattt gcagcctgaa tggcgaatgg gacgcgccct gtagcggcgc
 121 attaagcgcg gcgggtgtgg tggttacgcg cagcgtgacc gctacacttg ccagcgccct
 181 agcgcccgct cctttcgctt tcttcccttc ctttctcgcc acgttcgccg gctttccccg
 241 tcaagctcta aatcgggggc tccctttagg gttccgattt agtgctttac ggcacctcga
 301 ccccaaaaaa cttgattagg gtgatggttc acgtagtggg ccatcgccct gatagacggt
 361 ttttcgccct tgacgttgg agtccacgtt ctttaatagt ggactcttgt tccaaactgg
 421 aacaacactc aaccctatct cggtctattc ttttgattta taagggattt tgccgatttc
 481 ggcctattgg ttaaaaaatg agctgattta acaaaaattt aacgcgaatt taacaaaat
 541 attaacgttt acaatttcag gtggcacttt tcggggaaat gtgcgcggaa cccctatttg
 601 tttattttc taaatacatt caaatatgta tccgctcatg agacaataac cctgataaat
 661 gcttcaataa tattgaaaaa ggaagagtat gagtattcaa catttccgtg tcgcccttat
 721 tccctttttt gcggcatttt gccttcctgt ttttgctcac cagaaacgc tggtgaaagt
 781 aaaagatgct gaagatcagt tgggtgcacg agtgggttac atcgaactgg atctcaacag
 841 cggtaagatc cttgagagtt ttcgccccga gaacgtttt ccaatgatga gcacttttaa
 901 agttctgcta tgtggcgcgg tattatcccg tattgacgcc gggcaagagc aactcggtcg
 961 ccgcatacac tattctcaga atgacttggt tgagtactca ccagtcacag aaaagcatct
1021 tacggatggc atgacagtaa gagaattatg cagtgctgcc ataaccatga gtgataacac
1081 tgcggccaac ttacttctga caacgatcgg aggaccgaag gagctaaccg cttttttgca
1141 caacatgggg gatcatgtaa ctcgccttga tcgttgggaa ccggagctga atgaagccat
1201 accaaacgac gagcgtgaca ccacgatgcc tgtagcaatg gcaacaacgt tgcgcaaact
1261 attaactggc gaactactta ctctagcttc ccggcaacaa ttaatagact ggatggaggc
1321 ggataaagtt gcaggaccac ttctgcgctc ggcccttccg gctggctggt ttattgctga
1381 taaatctgga gccggtgagc gtgggtctcg cggtatcatt gcagcactgg ggccagatgg
1441 taagccctcc cgtatcgtag ttatctacac gacggggagt caggcaacta tggatgaacg
1501 aaatagacag atcgctgaga taggtgcctc actgattaag cattggtaac tgtcagacca
1561 agtttactca tatatacttt agattgattt aaaacttcat ttttaattta aaaggatcta
1621 ggtgaagatc cttttttgata atctcatgac caaaatccct taacgtgagt tttcgttcca
1681 ctgagcgtca gaccccgtag aaaagatcaa aggatcttct tgagatcctt ttttctgcg
1741 cgtaatctgc tgcttgcaaa caaaaaaacc accgctacca gcggtggttt gtttgccgga
1801 tcaagagcta ccaactcttt ttccgaaggt aactggcttc agcagagcgc agataccaaa
1861 tactgtcctt ctagtgtagc cgtagttagg ccaccacttc aagaactctg tagcaccgcc
1921 tacatacctc gctctgctaa tcctgttacc agtggctgct gccagtggcg ataagtcgtg
1981 tcttaccggg ttggactcaa gacgatagtt accggataag gcgcagcggt cgggctgaac
2041 ggggggttcg tgcacacagc ccagcttgga gcgaacgacc tacaccgaac tgagatacct
2101 acagcgtgag cattgagaaa gcgccacgct tcccgaaggg agaaaggcgg acaggtatcc
2161 ggtaagcggc agggtcggaa caggagagcg cacgagggag cttccagggg gaaacgcctg
2221 gtatctttat agtcctgtcg ggtttcgcca cctctgactt gagcgtcgat ttttgtgatg
2281 ctcgtcaggg gggcggagcc tatggaaaaa cgccagcaac gcggcctttt tacggttcct
2341 ggccttttgc tggccttttg ctcacatgtt ctttcctgcg ttatcccctg attctgtgga
2401 taaccgtatt accgcctttg agtgagctga taccgctcgc cgcagccgaa cgaccgagcg
2461 cagcgagtca gtgagcgagg aagcggaaga gcgcctgatg cggtattttc tccttacgca
2521 tctgtgcggt atttcacacc gcagaccagc cgcgtaacct ggcaaaatcg gttacggttg
2581 agtaataaat ggatgccctg cgtaagcggg tgtgggcgga caataaagtc ttaaactgaa
2641 caaatatgat ctaaactatg acaataaagt cttaaactag acagaatagt tgtaaactga
2701 aatcagtcca gttatgctgt gaaaaagcat actggacttt tgttatggct aaagcaaact
2761 cttcattttc tgaagtgcaa attgcccgtc gtattaaaga gggcgtggc caagggcatg
2821 gtaaagacta tattcgcggc gttgtgacaa tttaccgaac aactccgcgg ccgggaagcc
2881 gatctcggct tgaacgaatt gttaggtggc ggtacttggg tcgatatcaa agtgcatcac
2941 ttcttcccgt atgcccaact ttgtatagag agccactgcg gatcgtcac cgtaatctgc
3001 ttgcacgtag atcccataag caccaagcgc gttggcctca tgcttgagga gattgatgag
3061 cgcggtggca atgccctgcc tccggtgctc gccggagact gcgagatcat agatatagat
3121 ctcactacgc ggctgctcaa acctgggcag aacgtaagcc gcgagagcgc caacaaccgc
```

FIG. 12A

```
3181 ttcttggtcg aaggcagcaa gcgcgatgaa tgtcttacta cggagcaagt tcccgaggta
3241 atcggagtcc ggctgatgtt gggagtaggt ggctacgtct ccgaactcac gaccgaaaag
3301 atcaagagca gcccgcatgg atttgacttg gtcaggccg  agcctacatg tgcgaatgat
3361 gcccatactt gagccaccta actttgtttt agggcgactg ccctgctgcg taacatcgtt
3421 gctgctgcgt aacatcgttg ctgctccata acatcaaaca tcgacccacg gcgtaacgcg
3481 cttgctgctt ggatgcccga ggcatagact gtacaaaaaa acagtcataa caagccatga
3541 aaaccgccac tgcgccgtta ccaccgctgc gttcggtcaa ggttctggac cagttgcgtg
3601 agcgcatacg ctacttgcat tacagtttac gaaccgaaca ggcttatgtc aactgggttc
3661 gtgccttcat ccgtttccac ggtgtgcgtc acccggcaac cttgggcagc agcgaagtcg
3721 aggcatttct gtcctggctg gcgaacgagc gcaaggtttc ggtctccacg catcgtcagg
3781 cattggcggc cttgctgttc ttctacggca aggtgctgtg cacggatctg ccctggcttc
3841 aggagatcgg tagacctcgg ccgtcgcggc gcttgccggt ggtgctgacc ccggatgaag
3901 tggttcgcat cctcggtttt ctggaaggcg agcatcgttt gttcgcccag gactctagct
3961 atagttctag tggttggcct acgtacccgt agtggctatg gcagggcttg ccgccccgac
4021 gttggctgcg agccctgggc cttcacccga acttggggt  tggggtgggg aaaaggaaga
4081 aacgcgggcg tattggtccc aatgggtct  cggtggggta tcgacagagt gccagccctg
4141 ggaccgaacc ccgcgtttat gaacaaacga cccaacaccc gtgcgtttta ttctgtcttt
4201 ttattgccgt catagcgcgg gttccttccg gtattgtctc cttccgtgtt tcagttagcc
4261 tccccatct cccggtaccg catgctatgc atcggccgct ttacttgtac agctcgtcca
4321 tgccgagagt gatcccggcg gcggtcacga actccagcag gaccatgtga tcgcgcttct
4381 cgttggggtc tttgctcagg gcggactggg tgctcaggta gtggttgtcg ggcagcagca
4441 cggggccgtc gccgatgggg gtgttctgct ggtagtggtc ggcgagctgc acgctgccgt
4501 cctcgatgtt gtggcggatc ttgaagttca ccttgatgcc gttcttctgc ttgtcggcca
4561 tgatatagac gttgtggctg ttgtagttgt actccagctt gtgccccagg atgttgccgt
4621 cctccttgaa gtcgatgccc ttcagctcga tgcggttcac cagggtgtcg ccctcgaact
4681 tcacctcggc gcgggtcttg tagttgccgt cgtccttgaa gaagatggtg cgctcctgga
4741 cgtagccttc gggcatggcg gacttgaaga agtcgtgctg cttcatgtgg tcggggtagc
4801 ggctgaagca ctgcacgccg taggtcaggg tggtcacgag ggtgggccag ggcacgggca
4861 gcttgccggt ggtgcagatg aacttcaggg tcagcttgcc gtaggtggca tcgccctcgc
4921 cctcgccgga cacgctgaac ttgtggccgt ttacgtcgcc gtccagctcg accaggatgg
4981 gcaccacccc ggtgaacagc tcctcgccct tgctcaccat ggctcgagat cccgggcgtt
5041 taaattgtgt aatttatgta gctgtaattt ttaccttatt aatatttttt acgctttgca
5101 ttcgacgact gaactcccaa atatatgttt aactcgtctt ggtcgtttga atttttgttg
5161 ctgtgtttcc taatatttc  catcacctta aatatgttat tgtaatcctc aatgttgaac
5221 ttgcaattgg acacggcata gttttccata gtcgtgtaaa acatggtatt ggctgcattg
5281 taatacatcc gactgagcgg gtacggatct atgtgtttga gcagccgtt  caaaaactct
5341 gcatcgtcgc aaaacggaat ttggtacccg ggcgtatact ccggaatatt aatagatcat
5401 ggagataatt aaaatgataa ccatctcgca aataaataag tatttactg  ttttcgtaac
5461 agttttgtaa taaaaaaacc tataaatatt ccggattatt cataccgtcc caccatcggg
5521 cgccatggat cccggtccga agcgcgcgga attcaaaggc ctacgtcgac gagctcacta
5581 gtcgcggccg ctttcgaatc tagagcctgc agtctcgaca agcttgtcga gaagtcatag
5641 aggatcataa tcagccatac cacatttgta gaggttttac ttgctttaaa aaacctccca
5701 cacctccccc tgaacctgaa acataaaatg aatgcaattg ttgttgttaa cttgttttatt
5761 gcagcttata atggttacaa ataaagcaat agcatcacaa atttcacaaa taaagcattt
5821 ttttcactgc attctagttg tggtttgtcc aaactcatca atgtatctta tcatgtctgg
5881 atctgatcac tgcttgagcc taggagatcc gaaccagata agtgaaatct agttccaaac
5941 tattttgtca ttttaattt  tcgtattagc ttacgacgct acacccagtt cccatctatt
6001 ttgtcactct tccctaaata atccttaaaa actccatttc caccccctccc agttcccaac
6061 tattttgtcc gcccacagcg gggcattttt cttcctgtta tgttttaat  caaacatcct
6121 gccaactcca tgtgacaaac cgtcatcttc ggctactt
```

FIG. 12B

PULSE CHASE

PULSE CHASE

AYSMEASTPGDLVSIPTAISRAEGKITSALGSNQDVVDRIYKQVALESPLALLLNTESI
IMNAITSLSYQINGAANNSGCGAPVHEPDYIGGIGKELIVDDTSDVTSFYPSAFQEHL
NFIPAPTTGSGCTRIPSFDMSATHCYTHNVIFSGCRHHSHSHQYLALGVLRTSATGRV
FFSTLRSINLDDTQNRKSCSVSATPLGCDMLCSKVTETEEQDYNSVIPTSMVHGRLGF
DGQYHEKDLDVTTLFGDWVANYPGVGGGSFIDNRVWFPVYGGLKPSSPSDTGQEGRYV
IYKRYNDTCPDEQDYQIRMAKSSYKPGRFGGKRVQQAILSIKVSTSLGEDPVLTIPPN
TVTLMGAEGRVLTVGTSHFLYQRGSSYFSPALLYPMTVNNNTATLHSPYTFNAFTRPG
SVPCQASARCPNSCVTGVYTDPYPLVFHRNHTLRGVFGTMLDDEQARLNLVSAVFDNI
SRSRITRVSSSRTKAAYTTSTCFKVVKTNKTYCLSIAEISNTLFGEFRIVPLLVEILK
DDGV

FIG. 20A

```
   1 acgggtagaa cggtcggaga ggccacccct caatcgggag tcggacctca caacttccat
  61 tctgccgcat caccagtagc ggtcttcagt catgaaccgc gcagtttgcc aagttgcgct
 121 agagaatgat gaaagggaag cgaagaatac atggcgcttg gtattccgga tcgcaatctt
 181 acttttaaca gtaatgacct tagccatctc tgcagccgcc ctggcatata gtatggaggc
 241 tagcacacct ggcgaccttg taagcatacc aactgcgatc tctagggcag agggaaagat
 301 tacatctgca ctcggttcca atcaggatgt agtagatagg atatacaagc aggtggctct
 361 tgaatctccg ttggcattgc taaacaccga atctataatt atgaatgcaa taacatccct
 421 ctcttatcaa atcaatggag ctgcaaataa cagcgggtgt ggggcacctg ttcatgaccc
 481 agattacatc ggggggatag gtaaagaact tattgtggat gatactagtg atgtcacatc
 541 attctatccc tctgcgttcc aagaacacct gaatttatc ccggcaccca ctacaggatc
 601 aggttgcact cggatacct cattcgacat gagtgctacc cactgttata ctcacaatgt
 661 gatatttct ggttgcagac accattcaca ctcacatcag tatttagcac tgggtgtgct
 721 tcggacatct gcaacaggga gggtattctt ttctaccctg cgttccatca atttggatga
 781 cacccaaaat cggaagtctt gcagtgtgag tgcaactccc ttaggttgtg atatgctgtg
 841 ctctaaagtc acagagactg aggaacagga ttataattca gttatcccca catcgatggt
 901 acatggaagg ttagggtttg acggccaata ccatgagaag gacctagacg tcacaacatt
 961 atttggggac tgggtggcaa attcccagg agtgggaggt gggtctttta ttgacaaccg
1021 cgtatggttc ccagtctacg gagggctaaa acccagttcg cctagtgaca ctggacaaga
1081 agggagatat gtaatatata agcgatacaa tgacacatgc ccagatgagc aagattacca
1141 gattcggatg gctaagtctt cgtataagcc tgggcggttt ggtggaaagc gtgtacagca
1201 ggccatctta tctatcaagg tgtcaacatc cttgggtgag gacccggtgc tgactatacc
1261 gcccaacaca gtcacactca ggggccga aggcagagtt ctcacagtag gacatctca
1321 tttcttgtac cagcgagggt catcatattt ctctcctgct ttattatacc ctatgacagt
1381 caacaacaac acagccactc ttcatagtcc ttatacattc aatgctttca ctcggccagg
1441 tagtgtccct tgccaggctt cagcaagatg ccctaactca tgtgtcactg ggtctatac
1501 tgatccatat cccttagtct tccataggaa ccacaccttg cgagggtat tcgggacaat
1561 gcttgatgat gaacaagcaa gactcaacct tgtatctgca gtatttgata acatatcccg
1621 cagtcgcata acccgggtaa gttcaagcag aaccaaggca gcatacacga tcaacgtg
1681 ttttaaagtt gtcaagacca ataaaccta ttgcctcagc attgcagaaa tatccaatac
1741 cctctttggg gaattcagga tcgtcccttt actagttgag attctcaagg atgatgggt
1801 ttagaaagcc aggtctagcc ggttgagcca actgtgagag ggttggaaag atgacattgt
1861 gtcacctatc ttttgtagcg ccaagaatca aactgaatac cggccacgag ctcgaatcct
1921 ccgctgccag tcggtcataa tcactagtgc taatgtgatt agtctgaatc ttgtcgatag
1981 tcacttgatt aag
```

FIG. 20B

MDRAVSQVALENDEREAKNTWRLIFRIAILFLTVVTLAISVASL
LYSMGASTPSDLVGIPTRISRAEEKITSTLGSNQDVVDRIYKQVALESPLALLNTETT
IMNAITSLSYQINGAANNSGWGAPIHDPDYIGGIGKELIVDDASDVTSFYPSAFQEHL
NFIPAPTTGSGCTRIPSFDMSATHYCYTHNVILSGCRDHSHSHQYLALGVLRTSATGR
VFFSTLRSINLDDTQNRKSCSVSATPLGCDMLCSKATETEEEDYNSAVPTRMVHGRLG
FDGQYHEKDLDVTTLFGDWVANYPGVGGGSFIDSRVWFSVYGGLKPNTPSDTVQEGKY
VIYKRYNDTCPDEQDYQIRMAKSSYKPGRFGGKYIQQAILSIKVSTSLGEDPVLTVPP
NTVTLMGAEGRILTVGTSHFLYQRGSSYFSPALLYPMTVSNKTATLHSPYTFNAFTRP
GSIPCQASARCPNSCVTGVYTDPYPLIFYRNHTLRGVFGTMLDGEQARLNPASAVFDS
TSRSRITRVSSSSIKAAYTTSTCFKVVKTNKTYCLSIAEISNTLFGEFRIVPLLVEIL
KDDGVREARSG

FIG. 21A

```
   1 atggaccgcg ccgttagcca agttgcgtta gagaatgatg aaagagaggc aaaaaataca
  61 tggcgcttga tattccggat tgcaatctta ttcttaacag tagtgacctt ggctatatct
 121 gtagcctccc ttttatatag catgggggct agcacaccta gcgatcttgt aggcataccg
 181 actaggattt ccagggcaga agaaaagatt acatctacac ttggttccaa tcaagatgta
 241 gtagatagga tatataagca agtggccctt gagtctccat ggcattgtt aaatactgag
 301 accacaatta tgaacgcaat aacatctctc tcttatcaga ttaatggagc tgcaaacaac
 361 agcgggtggg gggcacctat tcatgaccca gattatatag ggggatagg caaagaactc
 421 attgtagatg atgctagtga tgtcacatca ttctatccct ctgcatttca agaacatctg
 481 aattttatcc cggcgcctac tacaggatca ggttgcactc gaataccctc atttgacatg
 541 agtgctaccc attactgcta cacccataat gtaatattgt ctggatgcag agatcactca
 601 cactcacatc agtatttagc acttggtgtg ctccggacat ctgcaacagg agggtattc
 661 ttttctactc tgcgttccat caacctggac gacacccaaa atcggaagtc ttgcagtgtg
 721 agtgcaactc ccctgggttg tgatatgctg tgctcgaaag ccacggagac agaggaagaa
 781 gattataact cagctgtccc tacgcggatg gtacatggga ggttagggtt cgacggccaa
 841 tatcacgaaa aggacctaga tgtcacaaca ttattcgggg actgggtggc caactaccca
 901 ggagtagggg gtggatcttt tattgacagc cgcgtatggt tctcagtcta cggagggtta
 961 aaacccaata cacccagtga cactgtacag gaagggaaat atgtgatata caagcgatac
1021 aatgacacat gcccagatga gcaagactac cagattcgaa tggccaagtc ttcgtataag
1081 cctggacggt tggtgggaa acgcatacag caggctatct tatctatcaa agtgtcaaca
1141 tccttaggcg aagacccggt actgactgta ccgcccaaca cagtcacact catggggcc
1201 gaaggcagaa ttctcacagt agggacatcc catttcttgt atcagcgagg gtcatcatac
1261 ttctctcccg cgttattata tcctatgaca gtcagcaaca aaacagccac tcttcatagt
1321 ccttatacat tcaatgcctt cactcggcca ggtagtatcc cttgccaggc ttcagcaaga
1381 tgccccaact cgtgtgttac tggagtctat acagatccat atcccctaat cttctataga
1441 aaccacacct gcgagggggt attcgggaca atgcttgatg gtgaacaagc aagacttaac
1501 cctgcgtctg cagtattcga tagcacatcc cgcagtcgca taactcgagt gagttcaagc
1561 agcatcaaag cagcatacac aacatcaact tgttttaaag tggtcaagac caataagacc
1621 tattgtctca gcattgctga aatatctaat actctcttcg gagaattcag aatcgtcccg
1681 ttactagttg agatcctcaa agatgacggg gttagagaag ccaggtctgg ctag
```

FIG. 21B

MGPRSSTRIPIPLMLTIRIALALSCVHLASSLDGRPLAAAGIVV
TGDKAVNIYTSSQTGSIIVKLLPNMPKDKEACAKAPLEAYNRTLTTLLTPLGDSIRRI
QESVTTSGGRRQKRFIGAIIGSVALGVATAAQITAASALIQANQNAANILRLKESITS
TNEAVHEVTDGLSQLAVAVGKMQQFVNDQFNNTAQELDCIKITQQVGVELNLYLTELT
TVFGPQITSPALTQLTIQALYNLAGGNMDYLLTKLGVGNNQLSSLIGSGLITGNPILY
DSQTQLLGIQVTLPSVGNLNNMRATYLETLSVSTTKGFASALVPKVVTQVGSVIEELD
TSYCIETDLDLYCTRIVTFPMSPGIYSCLNGNTSACMYSKTEGALTTPYMTLKGSVIA
NCKMTTCRCADPPGIISQNYGEAVSLIDRHSCNVLSLDGITLRLSGEFDATYQKNISI
LDSQVIVTGNLDISTELGNVNNSISNALDKLEESNSKLDKVNVKLTSTSALITYIALT
AISLVCGILSLVLACYLMYKQKAQQKTLLWLGNNTLGQMRATTKM

FIG. 22A

```
   1 acgggtagaa gagtttggat cccggttggc gcattcaagg cgcaagatgg gccccagatc
  61 ttctaccagg atcccaatac ctctgatgtt gaccatccgg atcgcgctgg cactgagttg
 121 tgtccatctg gcaagttctc ttgatggcag gcctcttgca gctgcaggga tcgtggtaac
 181 aggggataaa gcagtcaaca tatacacctc atcccagaca gggtcaatca tagtcaagtt
 241 actcccaaat atgcccaagg ataaagaggc gtgtgcaaaa gccccgttgg aggcatacaa
 301 caggacactg actactttgc tcaccccct tggtgattct atccgcagga tacaagagtc
 361 tgtgactaca tccggaggaa ggagacagaa acgctttata ggtgctatta tcggcagtgt
 421 agctcttggg gttgcaacag ctgcacagat aacagcagcc tcggccctga tacaagccaa
 481 tcagaatgct gccaacatcc tccggcttaa ggagagcatt actgcaacca atgaagctgt
 541 acatgaggtc actgacggat tatcacaact agcagtggca gttgggaaga tgcagcagtt
 601 tgttaatgac cagtttaata acacagctca ggaattggac tgtataaaaa ttacacagca
 661 ggttggtgta gaactcaacc tgtacctaac tgaattgact acagtattcg ggccacaaat
 721 aacttcccct gccttaactc agctgactat ccaggcgctt tacaacctag ctggtggtaa
 781 tatggattac ttgttgacta gttaggtgt agggaacaac caactcagct cattaattgg
 841 tagcggcttg atcaccggca accctattct gtacgactca cagactcaac tctttgggtat
 901 acaggtaact ttaccctcag tcggaaacct aaataatatg cgtgccacct acctggagac
 961 cttgtctgta agcacaacca agggatttgc ctcagcactc gtcccaaaag tggtgacaca
1021 ggtcggttct gtgatagaag aacttgacac ttcatactgt atagagaccg atttggattt
1081 gtattgtaca agaatagtga cattccctat gtctcctggt atttattcct gtttgaacgg
1141 caatacatcg gcttgcatgt attcaaagac tgaaggcgca cttactacgc catacatgac
1201 tctcaaaggc tcagttattg ccaattgcaa gatgacaaca tgcagatgtg cagacccccc
1261 gggtatcata tcgcaaaatt atggagaagc tgtgtctcta atagataggc actcatgcaa
1321 tgtcttatcc ttggacggga taactttgag gctcagtggg gaatttgatg caacttatca
1381 aaagaatatc tcaatactag attctcaagt aatagtgaca ggcaatctcg atatctcaac
1441 tgagcttggg aatgtcaaca actcgataag taatgctttg gataagttag aggaaagcaa
1501 cagcaaacta gacaaagtca atgtcaaact gaccagcaca tctgctctca ttacctatat
1561 cgctttaact gccatatctc ttgtttgcgg tatacttagt ctggttctag catgctacct
1621 aatgtacaag caaaagcgc aacaaagac cttgttatgg cttgggaata taccctggg
1681 tcagatgaga gccactacaa aaatgtgaat gcagatgaga ggcggaggta tccccaatag
1741 caatttgtgt gcaaattct
```

FIG. 22B

```
  1 mgsrpftknp apmmltirva lvlscicpan sidgrpfaaa givvtgdkav niytssqtgs
 61 iivkllpnlp kdkeacakap ldaynrtltt lltplgdsir riqesvttsg ggrqgrliga
121 iiggvalgva taaqitaaaa liqakqnaan ilrlkesiaa tneavhevtd glsqlavavg
181 kmqqfvndqf nktaqeldci kiaqqvgvel nlyltelttv fgpqitspal nkltiqalyn
241 laggnmdyll tklgignnql ssligsglit gnpilydsqt qllgiqvtlp svgnlnnmra
301 tyletlsvst trgfasalvp kvvtqvgsvi eeldtsycie tdldlyctri vtfpmspgiy
361 sclsgntsac mysktegalt tpymtikgsv ianckmttcr cvnppgiisq nygeavslid
421 kqscnvlslg gitlrlsget dvtyqknisi qdsqviitgn ldistelgnv nnsisnalnk
481 leesnrkldk vnvkltstsa lityivltii slvfgilsli lacylmykqk aqqktllwlg
541 nntldqmrat tkm
```

FIG. 23

MSSVFDEYEQLLAAQTRPNGAHGGGEKGSTLKVDVPVFTLNSDD
PEDRWSFVVFCLRIAVSEDANKPLRQGALISLLCSHSQVMRNHVALAGKQNEATLAVL
EIDGFANGTPQFNNRSGVSEERAQRFAMIAGSLPRACSNGTPFVTAGAEDDAPEDITD
TLERILSIQAQVWVTVAKAMTAYETADESETRRINKYMQQGRVQKKYILYPVCRSTIQ
LTIRQSLAVRIFLVSELKRGRNTAGGTSTYYNLVGDVDSYIRNTGLTAFFLTLKYGIN
TKTSALALSSLSGDIQKMKQLMRLYRMKGDNAPYMPLLGDSDQMSFAPAEYAQLYSFA
MGMASVLDKGTGKYQFAKDFMSTSFWRLGVEYAQAQGSSINEDMAAELKLTPAARRGL
AAAAQRVSEVTSSIDMPTQQVGVLTGLSEGGSQALQGGSNRSQGQPEAGDGETQFLDL
MRAVANSMREAPNSAQGTPQSGPPPTPGPSQDNDTDWGY

FIG. 24A

```
   1 gccaaaatgt cttccgtatt cgacgagtac gaacagctcc tcgcggctca gactcgcccc
  61 aatggagctc atggagggg ggagaaaggg agtaccttaa aagtagacgt cccggtattc
 121 actcttaaca gtgatgaccc agaagatagg tggagctttg tggtattctg cctccggatt
 181 gctgttagcg aagatgccaa caaccactc aggcaaggt ctctcatatc tcttttatgc
 241 tcccactcac aggtaatgag gaaccatgtt gcccttgcag ggaaacagaa tgaagccaca
 301 ttggccgtgc ttgagattga tggctttgcc aacggcacgc ccagttcaa caataggagt
 361 ggagtgtctg aagagagagc acagagattt gcgatgatag caggatctct ccctcgggca
 421 tgcagcaacg gcaccccgtt cgtcacagcc ggggctgaag atgatgcacc agaagacatc
 481 accgataccc tggagaggat cctctctatc caggctcaag tatgggtcac agtagcaaaa
 541 gccatgactg cgtatgagac tgcagatgag tcggaaacaa ggcgaatcaa taagtatatg
 601 cagcaggcca gggtccaaaa gaaatacatc ctctaccccg tatgcaggag cacaatccaa
 661 ctcacgatca gacagtctct tgcagtccgc atctttttgg ttagcgagct caagagaggc
 721 cgcaacacgg caggtggtac ctctacttat tataacctag tagggacgt agactcatat
 781 atcaggaata ccgggcttac tgcattcttc ttgacactca gtacggaat caacaccaag
 841 acatcagccc ttgcacttag tagcctctca ggcgacatcc agaagatgaa gcagctcatg
 901 cgtttgtatc ggatgaaagg agataatgcg ccgtacatga cattacttgg tgatagtgac
 961 cagatgagct ttgcgcctgc cgagtatgca caactttact cctttgccat gggtatggca
1021 tcagtcctag ataaaggtac tgggaaatac caatttgcca aggactttat gagcacatca
1081 ttctggagac ttggagtaga gtacgctcag gctcagggaa gtagcattaa cgaggatatg
1141 gctgccgagc taaagctaac cccggcagca aggaggggcc tgccagctgc tgcccaacga
1201 gtctccgagg tgaccagcag catagacatg cctactcaac aagtcggagt cctcactggg
1261 cttagcgagg ggggatccca agccctacaa ggcggatcga atagatcgca agggcaacca
1321 gaagccgggg atggggagac ccaattcctg gatctgatga gagcggtagc aaatagcatg
1381 agggaggcgc caaactctgc acaggcact ccccaatcgg ggcctccccc aactcctggg
1441 ccatcccaag ataacgacac cgactggggg tattgattga caaaacccag cctgcttcta
1501 caagaacatc ccaatgctct cacccgtagt cgacc
```

FIG. 24B

MDSSRTIGLYFDSALPSSNLLAFPIVLQDIGDGKKQIAPQYRIQ
RLDSWTDSKEDSVFITTYGFIFQVGNEEVTVGMISDNPKHELLSAAMLCLGSVPNVGD
LVELARACLTMVVTCKKSATDTERMVFSVVQAPQVLQSCRVVANKYSSVNAVKHVKAP
EKIPGSGTLEYKVNFVSLTVVPRKDVYKIPTAALKVSGSSLYNLALNVTIDVEVDPKS
PLVKSLSKSDSGYYANLFLHIGLMSTVDKKGKKVTFDKLERKIRRLDLSVGLSDVLGP
SVLVKARGARTRLLAPFFSSSGTACYPISNASPQVAKILWSQTARLRSVKVIIQAGTQ
RAVAVTADHEVTSTKIEKRHTIAKYNPFKK

FIG. 25A

```
   1 acgggtagaa tcggagtgcc ctgattgtgc caagatggac tcatctagga caatagggct
  61 atactttgat tctgcccttc cttctagcaa cctgttagca ttcccgatcg tcctacaaga
 121 cataggagat gggaagaagc aaatcgcccc gcaatatagg atccagcgtc ttgactcgtg
 181 gacagacagt aaagaagact cggtattcat caccacctat ggattcatct tccaggttgg
 241 gaatgaagaa gtcactgtcg gcatgatcag cgataatccc aagcacgagt tactttcagc
 301 tgcgatgctc tgcctaggaa gtgtcccgaa tgtcggagat cttgttgagt tggcaagggc
 361 ctgcctcact atggtggtaa catgcaagaa gagtgcaact gatactgaga gaatggtctt
 421 ctcggtagta caggcgcccc aggtgctgca aagctgtagg gtcgtggcaa acaaatactc
 481 gtcagtgaat gcagttaagc acgtgaaagc accagagaag atccctggga gcggaaccct
 541 agagtacaag gtgaattttg tctctttgac tgtggtgcca aggaaggatg tctacaaaat
 601 cccaaccgca gcattgaagg tatctggctc gagcctgtac aatcttgcgc tcaatgtcac
 661 tattgatgtg gaggtagacc caaagagccc gttagtcaaa tctctttcaa agtccgacag
 721 tggatactat gctaatcttt tcttacatat cggacttatg tccactgtag ataagaaggg
 781 aaagaaagtg acatttgaca agctggagag gaagataaga agactcgatt tatctgtcgg
 841 gctcagtgat gtgctcggac cttccgtgct tgtgaaggcg agaggtgcac ggactaggct
 901 gctggcacct ttcttctcta gcagtgggac agcctgctat cctatatcaa atgcctctcc
 961 tcaggtagct aagatactct ggagtcaaac tgcgcgcctg cggagtgtaa aagtcattat
1021 tcaagcgggc acccaacgcg ctgtcgcggt gaccgctgac cacgaggtca cctctactaa
1081 gatagaaaag aggcatacca ttgctaaata caatccttt aagaaataag ctgcatctct
1141 gagactgcaa tccgcccgct ttcccgaatc atcacgacgc ttaataatgg atctgtcctg
1201 attactcaca
```

FIG. 25B

MDSSRTIGLYFDSAHSSSNLLAFPIVLQDTGDGKKQIAPQYRIQ
RLDSWTDSKEDSVFITTYGFIFQVGNEEATVGMIDDKPKRELLSAAMLCLGSVPNTGD
LVELTRACLTMMVTCKKSATNTERMVFSVVQAPQVLQSCRVVPNKYSSVNAVKHVKAP
EKIPGSGTLEYKVNFVSLTVVPKKDVYKIPAAVLKISGSSLYNLALNVTINVEVDPRS
PLVKSLSKSDSGYYANLFLHIGLMTTVDRKGKKVTFDKLEKKIRSLDLSVGLSDVLGP
SVLVKARGARTKLLAPFFSSSGTACYPIANASPQVAKILWSQTACLRSVKIIIQAGTQ
RAVAVTADHEVTSTKLEKGHTLAKYNPFKK

FIG. 26A

```
   1 tgtgccaaga tggactcatc taggacaatt gggctgtact ttgattctgc ccattcttct
  61 agcaacctgt tagcatttcc gatcgtccta caagacacag gagatgggaa gaagcaaatc
 121 gccccgcaat ataggatcca gcgccttgac tcgtggactg atagtaagga agactcagta
 181 ttcatcacca cctatggatt catctttcaa gttgggaatg aggaagccac tgtcggcatg
 241 atcgatgata aacccaagcg cgagttactt ccgctgcga tgctctgcct aggaagcgtc
 301 ccaaataccg gagaccttgt tgagctgaca agggcctgtc tcactatgat ggtcacatgc
 361 aagaagagtg caactaatac tgagagaatg gttttctcag tagtgcaggc accccaagtg
 421 ctgcaaagct gtagggttgt gccaaacaaa tactcatcag tgaatgcagt caagcacgtg
 481 aaagcgccag agaagatccc cgggagtgga accctagaat acaaggtgaa ctttgtctcc
 541 ttgactgtgg taccgaagaa ggatgtctac aagatcccag ctgcagtatt gaagatttct
 601 ggctcgagtc tgtacaatct tgcgctcaat gtcactatta atgtggaggt agacccgagg
 661 agtcctttgg ttaaatctct gtctaagtct gacagcggat actatgctaa cctcttcttg
 721 catattggac ttatgaccac cgtagatagg aaggggaaga aagtgacatt tgacaagctg
 781 gaaaagaaaa taaggagcct tgatctatct gtcgggctca gtgatgtgct cgggccttcc
 841 gtgttggtaa aagcaaggag tgcacggact aagcttttgg cacctttctt ctctagcagt
 901 gggacagcct gctatcccat agcaaatgct tctcctcagg tggccaagat actctggagc
 961 caaaccgcgt gcctgcggag cgttaaaatc attatccaag caggtaccca acgcgctgtc
1021 gcagtgaccg ctgaccacga ggttacctct actaagctgg agaaggggca cacccttgcc
1081 aaatacaatc cttttaagaa ataagctgcg tctctgagat tgcgctccgc ccactcaccc
1141 agatcatcat gacacaaaaa actaatctgt cttgattatt tacagttagt ttacctgtcc
1201 atcaagttag aaaaaacacg ggt
```

FIG. 26B

```
   1 accaaacaga gaatcggtga gttacgataa aaggcgaagg agcaattgaa gtcgcacggg
  61 tagaaggtgt gaatctcgag tgcgagcccg aagcacaaac tcgaggaagc cttctgccaa
 121 catgtcttcc gtattcgacg agtacgaaca gctcctcgcg gctcagactc gccccaatgg
 181 agctcatgga ggggggagaa aagggagtac cttaaaagta gacgtcccgg tattcactct
 241 taacagtgat gacccagaag ataggtggag ctttgtggta ttctgcctcc ggattgctgt
 301 tagcgaagat gccaacaaac cactcaggca aggtgctctc atatctcttt tatgctccca
 361 ctcacaggta atgaggaacc atgttgccct tgcagggaaa cagaatgaag ccacattggc
 421 cgtgcttgag attgatggct ttgccaacgg cacgcccag ttcaacaata ggagtggagt
 481 gtctgaagag agagcacaga gatttgcgat gatagcagga tctctccctc gggcatgcag
 541 caacggcacc ccgttcgtca cagccgggc tgaagatgat gcaccagaag acatcaccga
 601 taccctggag aggatcctct ctatccaggc tcaagtatgg gtcacagtag caaaagccat
 661 gactgcgtat gagactgcag atgagtcgga acaaggcga atcaataagt atatgcagca
 721 aggcagggtc caaaagaaat acatcctcta ccccgtatgc aggagcacaa tccaactcac
 781 gatcagacag tctcttgcag tccgcatctt tttggttagc gagctcaaga gaggccgcaa
 841 cacggcaggt ggtacctcta cttattataa cctagtaggg gacgtagact catatatcag
 901 gaataccggg cttactgcat tcttcttgac actcaagtac ggaatcaaca ccaagacatc
 961 agcccttgca cttagtagcc tctcaggcga catccagaag atgaagcagc tcatgcgttt
1021 gtatcggatg aaaggagata atgcgccgta catgacatta cttggtgata gtgaccagat
1081 gagctttgcg cctgccgagt atgcacaact ttactccttt gccatgggta tggcatcagt
1141 cctagataaa ggtactggga ataccaatt tgccaaggac tttatgagca catcattctg
1201 gagacttgga gtagagtacg ctcaggctca gggaagtagc attaacgagg atatggctgc
1261 cgagctaaag ctaaccccgg cagcaaggag gggcctggca gctgctgccc aacgagtctc
1321 cgaggtgacc agcagcatag acatgcctac tcaacaagtc ggagtcctca ctgggcttag
1381 cgaggggga tcccaagccc tacaaggcgg atcgaataga tcgcaaggc aaccagaagc
1441 cggggatggg gagacccaat tcctggatct gatgagagcg gtagcaaata gcatgaggga
1501 ggcgccaaac tctgcacagg gcactcccca atcggggcct cccccaactc ctgggccatc
1561 ccaagataac gacaccgact gggggtattg attgacaaaa cccagcctgc ttctacaaga
1621 acatcccaat gctctcaccc gtagtcgacc cctcgatttg cggctctata tgaccacacc
1681 ctcaaacaaa catcccctc tttcctcct cccctgctg tacaactccg cacgccctag
1741 gcaacagagg cacaatgcgg ctcactaaca atcaaaacag agccgaggga attagaaaaa
1801 agtacgggta gaagagggat attcagagat cagggcaagt ctcccgagtc tctgctctct
1861 cctctacctg atagaccagg acaaacatgg ccacctttac agatgcagag atcgacgagc
1921 tatttgagac aagtggaact gtcattgaca acataattac agcccagggt aaaccagcag
1981 agactgttgg aaggagtgca atcccacaag gcaagacaa ggtgctgagc gcagcatggg
2041 agaagcatgg gagcatccag ccaccggcca gtcaagacaa ccccgatcga caggacagat
2101 ctgacaaaca accatccaca cccgagcaaa cgaccccgca tgacagcccg ccggccacat
2161 ccgctgacca gccccccacc caggccacag acgaagccgt cgacacacag ctcaggaccg
2221 gagcaagcaa ctctctgctg ttgatgcttg acaagctcag caataaatcg tccaatgcta
2281 aaaagggccc atggtcgagc ccccaagagg ggaatcacca acgtccgact caacagcagg
2341 ggagtcaacc cagtcgcgga aacagtcagg aaagaccgca gaaccaagtc aaggccgccc
2401 ctggaaacca gggcacagac gtgaacacag catatcatgg acaatgggag gagtcacaac
2461 tatcagctgg tgcaacccct catggtctcc gatcaaagca gagccaaaac aataccctg
2521 tttctgcgga tcatttccac ccacctgtag actttgtgca agcgatgatg tctattatgg
2581 agggatttc ccaaagagta agtaagttg cctatcaggt agatcttgtt tttaaacaga
2641 catcctccat ccctatgatg gggtccgaaa tccaacagct gaaaacattt gttgcagtca
2701 tggaagccaa cttgggaatg atgaagattt tggatcccgg ttgtgccaac atttcatctt
2761 tgagtgatct acgggcagtt gcccgatctc acccggtttt agtttcaggc cctggagacc
2821 catctcccta tgtgatacaa ggaggcgaaa tggcacttaa taaacttcg caaccagtgc
2881 cacatccatc tgaattgatt aaacccgcca ctgcatgcgg cctgatata ggagtggaga
2941 gggacactgt ccgtgcattg atcatgtcac gcccaatgca cccgagttct tcagccaagc
3001 tcctaagcaa gttagatgca gccgggtcga tcgaggaaat caggaaaatc aagcgccttg
3061 ctctaaatgg ctaattacta ctgccacacg tagcgggtcc ctgtccactc ggcatcacac
3121 ggaatctgca ccgagttccc ccccgcagac ccaaggtcca actctccaag cggcaatcct
3181 ctctcgcttc ctcagcccca ctgaatgatc gcgcaaccgc aattaatcta gctacattaa
3241 ggattaagaa aaaatacggg tagaattgga gtgccccaat tgtgccaaga tggactcatc
```

FIG. 27A

```
3301  taggacaatt gggctgtact ttgattctgc ccattcttct agcaacctgt tagcatttcc
3361  gatcgtccta caagacacag gagatgggaa gaagcaaatc gccccgcaat ataggatcca
3421  gcgccttgac ttgtggactg atagtaagga agactcagta ttcatcacca cctatggatt
3481  catctttcaa gttgggaatg aagaagccac tgtcggcatt atcgatgata aacccaagcg
3541  cgagttactt tccgctgcga tgctctgcct aggaagcgtc ccaaataccg gagaccttat
3601  tgagctggca agggcctgtc tcactatgat ggtcacatgc aagaagagtg caactaatac
3661  tgagagaatg gttttctcag tagtgcaggc accccaagtg ctgcaaagct gtagggttgt
3721  ggcaaacaaa tactcatcag tgaatgcagt caagcacgtg aaagcgccag agaagatccc
3781  cgggagtgga accctagaat acaaggtgaa ctttgtctcc ttgactgtgg taccgaagaa
3841  ggatgtctac aagatcccag ctgcagtatt gaagatttct ggctcgagtc tgtacaatct
3901  tgcgctcaat gtcactatta atgtggaggt agacccgagg agtcctttgg ttaaatctct
3961  gtctaagtct gacagcggat actatgctaa cctcttcttg catattggac ttatgaccac
4021  cgtagatagg aaggggaaga aagtgacatt tgacaagctg gaaagaaaa taaggagcct
4081  tgatctatct gtcgggctca gtgatgtgct cgggccttcc gtgttggtaa aagcaagagg
4141  tgcacggact aagcttttgg caccttctt ctctagcagt gggacagcct gctatcccat
4201  agcaaatgct tctcctcagg tggccaagat actctggagt caaaccgcgt gcctgcggaa
4261  cgttaaaatc attatccaag caggtaccca acgcgctgtc gcagtgaccg ctgaccacga
4321  ggttacctct actaagctgg agaagggca caccccttgcc aaatacaatc cttttaagaa
4381  ataagctgcg tctctgagat tgcgctccgc ccactcaccc agatcatcat gacacaaaaa
4441  actaatctgt cttgattatt tacagttagt ttacctgtcc atcaagttag aaaaaacacg
4501  ggtagaagac tctggatccc ggttggcgcc ctccaggtgc aggatgggct ccagaccttt
4561  taccaagaac ccagcaccta tgatgctgac tatccgggtc gcgctggtat tgagttgcat
4621  ctgtccggca aactccattg atggcaggcc ttttgcagct gcaggaattg tggttacagg
4681  agacaaagca gtcaacatat acacctcatc ccagacagga tcaatcatag ttaagctcct
4741  cccgaatctg cccaaggata aggaggcatg tgcgaaagcc cccttggatg catacaacag
4801  gacattgacc actttgctca ccccccttgg tgactctatc cgtaggatac aagagtctgt
4861  gactacatct ggaggggga gacagggcg ccttataggc gccattattg gcggtgtggc
4921  tcttggggtt gcaactgccg cacaaataac agcggccgca gctctgatac aagccaaaca
4981  aaatgctgcc aacatcctcc gacttaaaga gagcattgcc gcaaccaatg aggctgtgca
5041  tgaggtcact gacggattat cccaactagc agtggcagtt gggaagatgc agcagtttgt
5101  taatgaccaa tttaataaaa cagctcagga attagactgc ataaaaattg cacagcaagt
5161  tggtgtagag ctcaacctgt acctaaccga attgactaca gtattcggac cacaaatcac
5221  ttcacctgcc ttaaacaagc tgactattca ggcactttac aatctagctg gtgggaatat
5281  ggattactta ttgactaagt taggtatagg gaacaatcaa ctcagctcat taatcggtag
5341  cggcttaatc accggtaacc ctattctata cgactcacag actcaactct tgggtataca
5401  ggtaactcta ccttcagtcg ggaacctaaa taatatgcgt gccacctact tggaaacctt
5461  atccgtaagc acaaccaggg gatttgcctc ggcacttgtc ccaaaagtgg tgacacaggt
5521  cggttctgtg atagaagaac ttgacaccctc atactgtata gaaactgact tagatttata
5581  ttgtacaaga atagtaacgt tccctatgtc ccctggtatt tactcctgct tgagcggcaa
5641  tacatcggcc tgtatgtact caaagaccga aggcgcactt actacaccat atatgactat
5701  caaaggctca gtcatcgcta actgcaagat gacaacatgt agatgtgtaa acccccgggg
5761  tatcatatcg caaaactatg gagaagccgt gtctctaata gataaacaat catgcaatgt
5821  tttatcctta ggcgggataa ctttaaggct cagtggggaa ttcgatgtaa cttatcagaa
5881  gaatatctca atacaagatt ctcaagtaat aataacaggc aatcttgata tctcaactga
5941  gcttgggaat gtcaacaact cgatcagtaa tgctttgaat aagttagagg aaagcaacag
6001  aaaactagac aaagtcaatg tcaaactgac cagcacatct gctctcatta cctatatcgt
6061  tttgactatc atatctcttg tttttggtat acttagcctg attctagcat gctacctaat
6121  gtacaagcaa aaggcgcaac aaaagacctt attatggctt gggaataata ccctagatca
6181  gatgagagcc actacaaaaa tgtgaacaca gatgaggaac gaaggtttcc ctaatagtaa
6241  tttgtgtgaa agttctggta gtctgtcagt tcggagagtt aagaaaaaac taccggttgt
6301  agatgaccaa aggacgatat acgggtagaa cggtaagaga ggccgccct caattgcgag
6361  ccagacttca caacctccgt tctaccgctt caccgacaac agtcctcaat catggaccgc
6421  gccgttagcc aagttgcgtt agagaatgat gaaagagagg caaaaaatac atggcgcttg
6481  atattccgga ttgcaatctt attcttaaca gtagtgacct tggctatatc tgtagcctcc
6541  cttttatata gcatgggggc tagcacacct agcgatcttg taggcatacc gactaggatt
```

FIG. 27B

```
6601 tccagggcag aagaaaagat tacatctaca cttggttcca atcaagatgt agtagatagg
6661 atatataagc aagtggccct tgagtctcca ttggcattgt taaatactga gaccacaatt
6721 atgaacgcaa taacatctct ctcttatcag attaatggag ctgcaaacaa cagcgggtgg
6781 ggggcaccta ttcatgaccc agattatata gggggatag gcaaagaact cattgtagat
6841 gatgctagtg atgtcacatc attctatccc tctgcatttc aagaacatct gaattttatc
6901 ccggcgccta ctacaggatc aggttgcact cgaatacccct catttgacat gagtgctacc
6961 cattactgct acacccataa tgtaatattg tctggatgca gagatcactc acactcatat
7021 cagtatttag cacttggtgt gctccggaca tctgcaacag ggagggtatt cttttctact
7081 ctgcgttcca tcaacctgga cgacacccaa aatcggaagt cttgcagtgt gagtgcaact
7141 cccctgggtt gtgatatgct gtgctcgaaa gccacggaga cagaggaaga agattataac
7201 tcagctgtcc ctacgcggat ggtacatggg aggttagggt tcgacggcca atatcacgaa
7261 aaggacctag atgtcacaac attattcggg gactgggtgg ccaactaccc aggagtaggg
7321 ggtggatctt ttattgacag ccgcgtatgg ttctcagtct acggagggtt aaaacccaat
7381 tcacccagtg acactgtaca ggaagggaaa tatgtgatat acaagcgata caatgacaca
7441 tgcccagatg agcaagacta ccagattcga atggccaagt cttcgtataa gcctggacgg
7501 tttggtggga aacgcataca gcaggctatc ttatctatca aagtgtcaac atccttaggc
7561 gaagacccgg tactgactgt accgcccaac acagtcacac tcatgggggc cgaaggcaga
7621 attctcacag tagggacatc ccatttcttg tatcagcgag ggtcatcata cttctctccc
7681 gcgttattat atcctatgac agtcagcaac aaaacagcca ctcttcatag tcctatatca
7741 ttcaatgcct tcactcggcc aggtagtatc ccttgccagg cttcagcaag atgccccaac
7801 tcgtgtgtta ctggagtcta tacagatcca tatcccctaa tcttctatag aaaccacacc
7861 ttgcgagggg tattcgggac aatgcttgat ggtgaacaag caagacttaa ccctgcgtct
7921 gcagtattcg atagcacatc ccgcagtcgc ataactcgag tgagttcaag cagcatcaaa
7981 gcagcataca caacatcaac ttgttttaaa gtggtcaaga ccaataagac ctattgtctc
8041 agcattgctg aaatatctaa tactctcttc ggagaattca gaatcgtccc gttactagtt
8101 gagatcctca aagatgacgg ggttagagaa gccaggtctg gctagttgag tcaactatga
8161 aagagttgga aagatggcat tgtatcacct atcttctgcg acatcaagaa tcaaaccgaa
8221 tgccggcgcg tgctcgaatt ccatgtcgcc agttgaccac aatcagccag tgctcatgcg
8281 atcagattaa gccttgtcaa tagtctcttg attaagaaaa aatgtaagtg gcaatgagat
8341 acaaggcaaa acagctcatg gtaaataata cgggtaggac atggcgagct ccggtcctga
8401 aagggcagag catcagatta tcctaccaga gtcacacctg tcttcaccat tggtcaagca
8461 caaactactc tattattgga aattaactgg gctaccgctt cctgatgaat gtgacttcga
8521 ccacctcatt ctcagccgac aatggaaaaa aatacttgaa tcggcctctc ctgatactga
8581 gagaatgata aaactcggaa gggcagtaca ccaaactctt aaccacaatt ccagaataac
8641 cggagtactc caccccaggt gtttagaaga actggctaat attgaggtcc ctgattcaac
8701 caacaaattt cggaagattg agaagaagat ccaaattcac aacacgagat atggagaact
8761 gttcacaagg ctgtgtacgc atatagagaa gaaactgctg gggtcatctt ggtctaacaa
8821 tgtcccccgg tcagaggagt tcagcagcat tcgtacggat ccggcattct ggtttcactc
8881 aaaatggtcc acagccaagt ttgcatggct ccatataaaa cagatccaga ggcatctgat
8941 tgtggcagct aggacaaggt ctgcggccaa caaattggtg atgctaaccc ataaggtagg
9001 ccaagtcttt gtcactcctg aacttgttgt tgtgacgcat acgaatgaga acaagttcac
9061 atgtcttacc caggaacttg tattgatgta tgcagatatg atggagggca gagatatggt
9121 caacataata tcaaccacgg cggtgcatct cagaagctta tcagagaaaa ttgatgacat
9181 tttgcggtta atagacgctc tggcaaaaga cttgggtaat caagtctacg atgttgtatc
9241 actaatggag ggatttgcat acggagctgt ccagctactc gagccgtcag gtacatttgc
9301 gggagatttc ttcgcattca acctgcagga gcttaaagac attctaattg gcctcctccc
9361 caatgatata gcagaatccg tgactcatgc aatcgctact gtattctctg gtttagaaca
9421 gaatcaagca gctgagatgt tgtgcctgtt gcgtctgtgg ggtcacccac tgcttgagtc
9481 ccgtattgca gcaaaggcag tcaggagcca aatgtgcgca ccgaaaatgg tagactttga
9541 tatgatcctt caggtactgt ctttcttcaa gggaacaatc atcaacggat acagaaagaa
9601 gaatgcaggt gtgtggccgc gagtcaaagt ggatacaata tatgggaagg tcattgggca
9661 actacatgca gattcagcag agatttcaca cgatatcatg ttgagagagt ataagagttt
9721 atctgcactt gaatttgagc catgtataga atacgaccct gtcactaacc tgagcatgtt
9781 cctaaaagac aaggcaatcg cacacccaa cgataattgg cttgcctcgt ttaggcggaa
9841 ccttctctcc gaagaccaga agaaacatgt aaaggaagcg acttcgacta accgcctctt
```

FIG. 27C

```
 9901 gatagagttt ttagagtcaa atgattttga tccatataaa gagatggaat atctgacgac
 9961 ccttgagtac cttagagatg acaatgtggc agtatcatac tcgctcaaag agaaggaagt
10021 gaaagttaat ggacggatct tcgctaagct gacaaagaag ttaaggaact gtcaggtgat
10081 ggcggaaggg atcctagccg atcagattgc acctttcttt cagggaaatg gagtcattca
10141 ggatagcata tccttgacca agagtatgct agcgatgagt caactgtctt ttaacagcaa
10201 taagaaacgt atcactgact gtaaagaaag agtatcttca aaccgcaatc atgatccgaa
10261 aagcaagaac cgtcggagag ttgcaacctt cataacaact gacctgcaaa agtactgtct
10321 taattggaga tatcagacga tcaaattgtt cgctcatgcc atcaatcagt tgatgggcct
10381 acctcatttc ttcgagtgga ttcacctaag actgatggac actacgatgt tcgtaggaga
10441 ccctttcaat cctccaagtg accctactga ctgtgacctc tcaagagtcc ctaatgatga
10501 catatatatt gtcagtgcca gagggggtat cgaaggatta tgccagaagc tatggacaat
10561 gatctcaatt gctgcaatcc aacttgctgc agctagatcg cattgtcgtg ttgcctgtat
10621 ggtacagggt gataatcaag taatagcagt aacgagagag gtaagatcag atgactctcc
10681 ggagatggtg ttgacacagt tgcatcaagc cagtgataat ttcttcaagg aattaatcca
10741 tgtcaatcat ttgattggcc ataatttgaa ggatcgtgaa accatcaggt cagacacatt
10801 cttcatatac agcaaacgaa tcttcaaaga tggagcaatc ctcagtcaag tcctcaaaaa
10861 ttcatctaaa ttagtgctag tgtcaggtga tctcagtgaa aacaccgtaa tgtcctgtgc
10921 caacattgcc tctactgtag cacggctatg cgagaacggg cttcccaaag acttctgtta
10981 ctatttaaac tatataatga gttgtgtgca gacatacttt gactctgagt tctccatcac
11041 caacaattcg cacccccgatc ttaatcagtc gtggattgag gacatctctt ttgtgcactc
11101 atatgttctg actcctgccc aattaggggg actgagtaac cttcaatact caaggctcta
11161 cactagaaat atcggtgacc cggggactac tgcttttgca gagatcaagc gactagaagc
11221 agtgggacta ctgagtccta acattatgac taatatctta actaggccgc ctgggaatgg
11281 agattgggcc agtctgtgca acgacccata ctctttcaat tttgagactg ttgcaagccc
11341 aaatattgtt cttaagaaac atacgcaaag agtcctattt gaaacttgtt caaatccctt
11401 attgtctgga gtgcacacag aggataatga ggcagaagag aaggcattgg ctgaattctt
11461 gcttaatcaa gaggtgattc atccccgcgt tgcgcatgcc atcatggagg caagctctgt
11521 aggtaggaga aagcaaattc aagggcttgt tgacacaaca aacactgtaa ttaagattgc
11581 gcttactagg aggccattag gcatcaagag gctgatgcgg atagtcaatt attctagcat
11641 gcatgcaatg ctgtttagag acgatgtttt ttcctctagt agatccaacc accccttagt
11701 ctcttctaat atgtgttctc tgacactggc agactatgca cggaatagaa gctggtcacc
11761 tttgacggga ggcaggaaaa tactgggtgt atctaatcct gatacgatag aactcgtaga
11821 gggtgagatt cttagtgtaa gcggagggtg tacaagatgt gacagcggag atgaacaatt
11881 tacttggttc catcttccaa gcaatataga attgaccgat gacaccagca agaatcctcc
11941 gatgagggta ccatatctcg ggtcaaagac acaggagagg agagctgcct cacttgcgaa
12001 aatagctcat atgtcgccac atgtgaaggc tgccctaagg gcatcatccg tgttgatctg
12061 ggcttatggg gataatgaag taaattggac tgctgctctc acgattgcaa aatctcggtg
12121 taatgtaaac ttagagtatc ttcggttact gtcccctta cccacggctg gaatccttca
12181 acatagacta gatgatggta taactcagat gacattcacc cctgcatctc tctacaggtg
12241 tcaccttaca ttcacatatc caatgattct caaaggctgt tcactgaaga aggagtcaaa
13201 gaggggaatg tggtttacca acagagtcat gctcttgggt ttatctctaa tcgaatcgat
12361 ctttccaatg acaacaacca gaacatatga tgagatcaca ctgcacctac atagtaaatt
12421 tagttgctgt atcagggaag cacctgttgc ggttcctttc gagctacttg gggtggcacc
12481 ggaactgagg acagtgacct caaataagtt tatgtatgat cctagccctg tatcggaggg
12541 agactttgcg agacttgact tagctatctt caagagttat gagcttaatc tggagtcata
12601 tcccacgata gagctaatga acattctttc aatatccagc gggaagttga ttggccagtc
12661 tgtggtttct tatgatgaag atacctccat aaagaatgat gccataatag tgtatgacaa
12721 tacccgaaat tggatcagtg aagctcagaa tcagatgtg gtccgcctat ttgaatatgc
12781 agcacttgaa gtgctcctcc accgttctta ccaactctat tacctgagag taagaggcct
12841 agacaatatt gtcttatata tgggtgattt ataagaat atgccaggaa ttctactttc
12901 caacattgca gctacaatat ctcatcctgt cattcattca aggttacatg cagtgggcct
12961 ggtcaaccat gacggatcac accaacttgc agatacggat tttatcgaaa tgtctgcaaa
13021 actgttagta tcttgcaccc gacgtgtgat ctccggctta tattcaggaa ataagtatga
13081 tctgctgttc ccatctgtct tagatgataa cctgaatgag aagatgcttc agctgatatc
13141 ccggttatgc tgtctgtaca cggtactctt tgctacaaca agagaaatcc cgaaaataag
```

FIG. 27D

```
13201 aggcttaact gcagaagaga aatgttcaat actcactgag tatttactgt cggatgctgt
13261 gaaaccatta cttagccccg atcaagtgag ctctatcatg tctcctaaca taattacatt
13321 cccagctaat ctgtactaca tgtctcggaa gagcctcaat ttgatcaggg aaagggagga
13381 cagggatact atcctggcgt tgttgttccc ccaagagcca ttattagagt tcccttctgt
13441 gcaagatatt ggtgctcgag tgaaagatcc attcacccga caacctgcgg cattttgca
13501 agagttagat ttgagtgctc cagcaaggta tgacgcattc acacttagtc agattcatcc
13561 tgaactcaca tctccaaatc cggaggaaga ctacttagta cgatacttgt tcagagggat
13621 agggactgca tcttcctctt ggtataaggc atcccatctc ctttctgtac ccgaggtaag
13681 atgtgcaaga cacgggaact ccttatactt ggctgaagga agcggagcca tcatgagtct
13741 tcttgaactg catgtaccac atgaaactat ctattacaat acgctctttt caaatgagat
13801 gaacccccg caacgacatt tcgggccgac cccaactcag tttttgaatt cggttgttta
13861 taggaatcta caggcggagg taacatgcaa ggatggattt gtccaagagt tccgtccatt
13921 atggagagaa atacagagg aaagtgacct gacctcagat aaagcagtgg ggtatattac
13981 atctgcagta ccctacagat ctgtatcatt gctgcattgt gacattgaaa ttcctccagg
14041 gtccaatcaa agcttactag atcaactagc tatcaattta tctctgattg ccatgcattc
14101 tgtaagggag ggcggggtag taatcatcaa agtgttgtat gcaatgggat actactttca
14161 tctactcatg aacttgtttg ctccgtgttc cacaaaagga tatattctct ctaatggtta
14221 tgcatgtcga ggggatatgg agtgttacct ggtatttgtc atgggttacc tgggcgggcc
14281 tacatttgta catgaggtgg tgaggatggc aaaaactctg gtgcagcggc acggtacgct
14341 cttgtctaaa tcagatgaga tcacactgac caggttattc acctcacagc ggcagcgtgt
14401 gacagacatc ctatccagtc ctttaccaag attaataaag tacttgagga agaatattga
14461 cactgcgctg attgaagccg ggggacagcc cgtccgtcca ttttgtgcgg aaagtttggt
14521 gagcacgcta gcgaacataa ctcagataac ccagattatc gctagtcaca ttgacacagt
14581 catccggtct atgatatata tggaagctga gggtgatctc gctgacacag tatttctatt
14641 taccccttac aatctctcta ctgacgggaa aaagaggaca tcacttaaac agtgcacgag
14701 acagatccta gaggttacaa tactaggtct tagagtcgaa atctcaata aaataggcga
14761 tataatcagc ctagtgctta aggcatgat ctccatggag gacctatcc cactaaggac
14821 atacttgaag catagtacct gccctaaata tttgaaggct gtcctaggta ttaccaaact
14881 caaagaaatg tttacagaca cttctgtact gtacttgact cgtgctcaac aaaaattcta
14941 catgaaaact ataggcaatg cagtcaaagg atattacagt aactgtgact cctaacgaaa
15001 atcacatatt aataggctcc tttttggcc aattgtattc ttgttgattt aattatatta
15061 tgttagaaaa aagttgaact ctgactcctt aggactcgaa ttcgaactca ataaatgtc
15121 tttaaaaaag gttgcgcaca attattcttg agtgtagtct cgtcattcac caaatctttg
15181 tttggt
```

FIG. 27E

MSPQRDRINAFYKDNPHPKGSRIVINREHLMIDRPYVLLAVLFV
MFLSLIGLLAIAGIRLHRAAIYTAEIHKSLSTNLDVTNSIEHQVKDVLTPLFKIIGDE
VGLRTPQRFTDLVKFISDKIKFLNPDREYDFRDLTWCINPPERIKLDYDQYCADVAAE
ELMNALVNSTLLEARATNQFLAVSKGNCSGPTTIRGQFSNMSLSLLDLYLSRGYNVSS
IVTMTSQGMYGGTYLVEKPNLSSKGSELSQLSMHRVFEVGVIRNPGLGAPVFHMTNYF
EQPVSNDFSNCMVALGELKFAALCHREDAITIPYQGSGKGVSFQLVKLGVWKSPTDMQ
SWVPLSTDDPVIDRLYLSSHRGVIADNQAKWAVPTTRTDDKLRMETCFQQACKGKIQA
LCENPEWAPLKDNRIPSYGVLSVNLSLTVELKIKIASGFGPLITHGSGMDLYKSNHNN
VYWLTIPPMKNLALGVINTLEWVPRFKVSPNLFTVPIKEAGEDCHAPTYLPAEVDGDV
KLSSNLVILPGQDLQYVLATYDTSRVEHAVVYYVYSPSRSFSYFYPFRLPIKGFPIEL
QVECFTWDQKLWCRHFCVLADSESGGHITHSGMVGMGVSCTVTREDGTNRR

FIG. 32A

```
   1 atgtcaccac aacgagaccg gataaatgcc ttctacaaag acaaccccca tcctaaggga
  61 agtaggatag ttattaacag agaacatctt atgattgata gaccttatgt tttgctggct
 121 gttctgttcg tcatgtttct gagcttgatc gggctgctag ccattgcagg cattagactg
 181 catcgggcag ccatctacac cgcagagatc cataaaagcc tcagcaccaa tctagatgta
 241 actaactcaa tcgagcatca ggtcaaggac gtgctgacac cactcttcaa gatcattggt
 301 gatgaagtgg gcctgaggac acctcagaga ttcactgatc tagtgaaatt catctctgac
 361 aagattaaat tccttaatcc ggatagggag tacgacttca gagatctcac ttggtgtatc
 421 aacccgccag agagaatcaa attggattat gaccaatact gtgcagatgt ggctgctgaa
 481 gaactcatga atgcattggt gaactcaact ctactggaag ccagggcaac caatcagttc
 541 ctagctgtct caaaggggaa ctgctcaggg cccactacaa tcagaggtca attctcaaac
 601 atgtcgctgt ccctgttgga cttgtattta agtcgaggtt acaatgtgtc atctatagtc
 661 actatgacat cccagggaat gtacggggga acttacctag tggaaaagcc taatctgagc
 721 agcaaaggtt cggagttgtc acaactgagc atgcaccgag tgtttgaagt aggtgttatc
 781 agaaatccgg gtttggggc tccggtgttc catatgacaa actattttga gcaaccagtc
 841 agtaatgatt tcagcaactg catggtggct taggagagc tcaaattcgc agcccttgt
 901 cacaggagg atgctatcac aattccctat cagggatcag ggaaaggtgt cagcttccag
 961 ctcgtcaagc taggtgtctg gaaatcccca accgacatgc aatcctgggt cccctatca
1021 acggatgatc cagtgataga caggctttac ctctcatctc acagaggcgt tatcgctgac
1081 aatcaagcaa aatgggctgt cccgacaaca cggacagatg acaagttgcg aatggagaca
1141 tgcttccagc aggcgtgtaa gggtaaaatc caagcactct gcgagaatcc cgagtgggca
1201 ccattgaagg ataacaggat tccttcatac ggggtcttgt ctgttaatct gagtctgaca
1261 gttgagctta aaatcaaaat tgcttcaggg ttcgggccat tgatcacaca cggttcaggg
1321 atggacctgt acaaatccaa ccacaacaat gtgtattggc tgactatccc gccaatgaag
1381 aacctagcct taggtgtaat caacacattg gagtgggtac cgagattcaa ggttagtccc
1441 aacctcttca ctgttccaat caaggaagca ggcgaggact gccatgcccc aacataccta
1501 cctgcggagg tggatggtga tgtcaaactc agttccaatc tggtgattct acctggtcaa
1561 gacctccaat atgtttggc aacctacgat acttccagag ttgagcatgc tgtggtttat
1621 tacgtttaca gcccaagccg ctcatttct tactttatc cttttaggtt gcctataaag
1681 gggttcccca tcgaattaca ggtggaatgc ttcacttggg accaaaaact ctggtgccgt
1741 cacttctgtg tgcttgcgga ctcagaatct ggtggacata tcactcactc tgggatggtg
1801 ggcatgggag ttagctgtac agtcactcga gaagatggaa ccaaccgcag atag
```

FIG. 32B

MSPQRDRINAFYKDNPHPKGSRIVINREHLMIDRPYVLLAVLFV
MFLSLIGLLAIAGIRLHRAAIYTAEIHKSLSTNLDVTNSIEHQVKDVLTPLFKIIGDE
VGLRTPQRFTDLVKFISDKIKFLNPDREYDFRDLTWCINPPERIKLDYDQYCADVAAE
ELMNALVNSTLLEARATNQFLAVSKGNCSGPTTIRGQFSNMSLSLLDLYLSRGYNVSS
IVTMTSQGMYGGTYLVEKPNLSSKGSELSQLSMHRVFEVGVIRNPGLGAPVFHMTNYF
EQPVSNDFSNCMVALGELKFAALCHREDSITIPYQGSGKGVSFQLVKLGVWKSPTDMQ
SWVPLSTDDPVIDRLYLSSHRGVIADNQAKWAVPTTRTDDKLRMETCFQQACKGKIQA
LCENPEWAPLKDNRIPSYGVLSVNLSLTVELKIKIASGFGPLITHGSGMDLYKSNHNN
VYWLTIPPMKNLALGVINTLEWVPRLKVSPNLFTVPIKEAGEDCHAPTYLPAEVDGDV
KLSSNLVILPGQDLQYVLATYDTSRVEHAVVYYVYSPSRSFSYFYPFRLPIKGFPIEL
QVECFTWDQKLWCRHFCVLADSETGGHITHSGMVGMGVSCTVTREDGTNRR

FIG. 33A

```
   1 atgtcaccac aacgagaccg gataaatgcc ttctacaaag acaaccccca tcctaaggga
  61 agtaggatag ttattaatag agaacatctt atgattgata gaccttatgt tttgctggct
 121 gttctattcg tcatgtttct gagcttgatc gggctgctag ccattgcagg cattagactg
 181 catcgggcag ccatctacac cgcagagatc cataaaagcc tcagcaccaa tctagatgta
 241 actaactcaa tcgagcatca ggtcaaggac gtgctgacac cactcttcaa gatcatcggt
 301 gatgaagtgg gcctgaggac acctcagaga ttcactgacc tagtgaaatt catctctgac
 361 aagattaaat tccttaatcc ggatagggag tacgacttca gagatctcac ttggtgtatc
 421 aacccgccag agagaatcaa attggattat gaccaatact gtgcagatgt ggctgctgaa
 481 gaactcatga atgcattggt gaactcaact ctactggagg ccagggcaac caatcagttc
 541 ttagctgtct caaaggaaa ctgctcaggg cccactacaa tcagggtca attctcaaac
 601 atgtcgctgt ccctgttgga cttgtattta agtcgaggtt acaatgtgtc atctatagtc
 661 actatgacat cccagggaat gtacggggga acttacctag tggaaaagcc taatctgagc
 721 agcaaagggt cagagttgtc acaactgagc atgcaccggg tgtttgaggt aggtgttatc
 781 agaaatccgg gtttggggc tccagtgttc catatgacaa actattttga gcaaccagtc
 841 agtaatgatt tcagcaactg catggtggct ttaggggagc tcaaattcgc agccctttgt
 901 cacagggagg attctatcac aattccctat caagggtcag ggaaaggtgt cagcttccag
 961 ctcgtcaagc taggtgtctg gaaatcccca accgacatgc aatcctgggt cccctatca
1021 acggatgatc cagtgataga caggctttac ctctcatctc acagaggcgt tatcgctgac
1081 aatcaagcaa aatgggctgt cccgacaaca cggacagatg acaagttgcg aatggagaca
1141 tgcttccagc aggcgtgtaa gggtaaaatc aagcactct gcgagaatcc cgagtgggca
1201 ccattgaagg ataacaggat tccttcatac ggggtcttgt ctgttaatct gagtctgaca
1261 gttgagctta aaatcaaaat tgcttcagga ttcgggccat tgatcacaca cggttcaggg
1321 atggacctgt acaagtccaa ccacaacaat gtgtattggc tgactatccc gccaatgaag
1381 aacctagcct taggtgtaat caacacattg gaatgggtac cgagactcaa ggttagtccc
1441 aacctcttca ctgttccaat caaggaggca ggcgaggact gccatgcccc gacataccta
1501 cctgcggagg tggatggtga tgtcaaactc agttccaatc tggtgattct acctggtcaa
1561 gacctccaat atgttttggc aacctacgat acttccagag ttgaacatgc tgtggtttat
1621 tacgtttaca gcccaagccg ctcatttct tacttttatc cttttaggtt gcctataaag
1681 ggggtcccca tcgaattaca ggtggaatgc ttcacatggg accaaaaact ctggtgccgt
1741 cacttctgtg tgcttgcgga ctcagaaact ggtggacata tcactcactc tgggatggtg
1801 ggcatgggag tcagctgcac agtcactcgg gaagatggaa ccaaccgcag atag
```

FIG. 33B

MSLQRDRINAFYKDNPHPKGSRIVINREHLMIDRPYVLLAVLFV
MFLSLIGLLAIAGIRLHRAAIYTAEIHKSLSTNLDVTNSIEHQVKDVLTPLFKIIGDE
VGLRTPQRFTDLVKFISDKIKFLNPDREYDFRDLTWCINPPERIKLNYDQYCADVAAE
ELMNALVNSTLLETRTTNQFLAVSKGNCSGPTTIRGQFSNMSLSLLDLYLSRGYNVSS
IVTMTSQGMYGGTYLVEKPNLNSKGSELSQLSMYRVFEVGVIRNPGLGAPVFHMTNYF
EQPISNDLSNCMVALGELKLAALCHGGDSITIPYQGSGKGVSFQLVKLGVWKSPTDMQ
SWVPLSTDDPVIDRLYLSSHRGVITDNQANWAVPTTRTDDKLRMETCFQQACKGKIQA
LCENPEWAPLKDSRIPSYGVLSVNLSLAAEPKIKIASGFGPLITHGSGMDLYKSNHNN
VYWLTIPPMKNLALGVINTLEWIPRLKVSPNLFTVPIKEAGENCHAPTYLPAEVDGDV
KLSSNLVILPGQDLQYVLATYDTSRVEHAVVYYVYSPSRSFSYFYPFRLPIKGTPIEL
QVECFTWDQRLWCRHFCVLADSESGGHITHSGMVGMGVSCTVNREDEANRR

FIG. 34A

```
   1 atgtcactgc aacgagaccg gataaatgcc ttctacaaag ataaccctca ttccaaagga
  61 agtaggatag ttattaacag agaacatctc atgattgata gaccttatgt tttgctggct
 121 gttctgttcg tcatgtttct gagcttgatc gggttgctgg ccattgcagg cattaggctt
 181 catcgggcag ctatctacac tgcagagatc cataaaagcc tcagcaccaa tctagatgta
 241 actaactcaa tcgagcatca ggtcaaggat gtgctgacac cgctcttcaa aatcatcggt
 301 gatgaagtgg gcctgagaac acctcagaga ttcactgacc tagtgaaatt catctctgac
 361 aagatcaaat tccttaatcc ggatagggag tatgacttca gagatctcac ttggtgtatc
 421 aacccgccag agagaatcaa attgaattat gatcaatact gtgcagatgt ggctgctgaa
 481 gagctcatga atgcattagt gaactcaact ctactggaga ccagaacaac caatcagttc
 541 ctagctgtct caaagggaaa ctgctcaggg cccactacca tcagaggtca attctcaaac
 601 atgtcgctgt ctctgttaga cttatattta agtcgaggtt acaatgtgtc atctatagtc
 661 actatgacgt cccagggaat gtatggggga acttacctag ttgaaaagcc caatctgaac
 721 agcaaaggat cagaattatc acaactgagc atgtaccgag tgtttgaagt aggtgttata
 781 agaaatccag gcttggggc tccggtgttc catatgacaa actattttga acaaccaatc
 841 agcaaggatc tcagcaactg catggtagct tggggggagc tcaaactcgc agcccttgt
 901 cacggggggag attccatcac aattccctat cagggatcag ggaaaggtgt cagcttccaa
 961 ctcgtcaagc taggtgtctg gaaatcccca accgacatgc aatcctgggt cccctatca
1021 acggatgacc cagtgataga caggctttac ctctcatctc acagaggtgt catcactgac
1081 aatcaagcaa attgggctgt tccgacaaca cgaacagatg ataagttgcg gatggagaca
1141 tgcttccagc aggcgtgcaa gggcaaaatc caagcactct gtgaaaatcc cgagtgggca
1201 ccgttaagg acagcaggat tccttcatac ggggtcttgt ctgtcgacct gagtctggca
1261 gctgagccca aaatcaaaat tgcttcggga ttcggtccat tgatcactca cggttcaggg
1321 atggacctat acaaatccaa ccacaacaat gtgtattggc tgactatccc gccaatgaag
1381 aacttagcct taggtgtaat caacacattg gagtggatac cgagactcaa ggttagtccc
1441 aacctcttca ctgtcccaat taaggaagct ggcgagaact gccatgcccc aacataccta
1501 cctgcggagg tggatggtga tgtcaaactc agttccaatc tggtgatttt acctggtcaa
1561 gatctccaat atgttttggc aacctacgat acttccagag ttgaacatgc tgtggtttat
1621 tacgtttaca gcccaagccg ctcattctct tactttatc cctttaggtt acctataaag
1681 gggatcccca tcgaattaca agtggaatgc ttcacatggg accaaagact ctggtgccgt
1741 cacttctgtg tgcttgctga ctcggaatct ggtggacata tcacccactc tgggatggtg
1801 ggcatgggag tcagctgcac agtcaaccgg gaagacgaag ccaatcgcag atag
```

FIG. 34B

VMTRSSHQSLVIKLMPNITLLNNCTRVEIAEYRRLLRTVLEPIRDALNAMTQNIRPFQ
SVASSRRHKRFAGVVLAGAALGVATAAQITAGIALHQSMLNSQAIDNLRASLETTNQA
IEAIRQAGQEMILAVQGVQDYINNELIPSMNQLSCDLIGQKLGLKLLRYYTEILSLFG
PSLRDPISAEISIQALSYALGGDINKVLEKLGYSGGDLLGILESRGIKARITHVDTES
YFIVLSIAYPTLSEIKGVIVHRLEGVSYNIGSQEWYTTVPKYVATQGYLISNFDESSC
TFNPEGTVCSQNALYPMSPLLQECLRGSTKSCARTLVSGSFGNRFILSQGNLIANCAS
ILCKCYTTGTIINQDPDKILTYIAADHCPVVEVNGVTIQVGSRRYPDAVYLHRIDLGP
PISLERLDVGTNLGNAIAKLEDAKELLESSDQILRSMKGLSSTSIVYILIAVCLGGLI
GIPALICCCRGRCNKKGEQVGMSRPGLKPDLTGTSKSYVRSL

FIG. 35A

```
   1 cttagggtca aggaacatac acacccaaca gaacccagac cccgacccac ggcgccgcgc
  61 ccccaacccc cgacaaccag agggagcccc caaccaatcc cgccggctcc ctcggtgccc
 121 acagacaggc acaccaaccc ccgaacaggc ccagtgccca gccatcgaca atctaagacg
 181 ggggggcccc ccccaaaaaa agccccccagg ggccgacagc cagcaccgcg cggaagccca
 241 cccacccccac acacgaccac gacaaccaaa ccagaatcca gaccaccctg ggccgccagc
 301 tcccagactc ggccatcacc ccgcagaaag gaaagggcac aacccgcgca ccccagcccc
 361 gatccggcgg gcagccaccc aacccgaacc ggcacccaag agcgatcccc gaaggacccc
 421 cgagccgcaa aggacatcag tatcccacag cctctccaag tccctggtc tcttcctctt
 481 ctcgaaggga ccaaaagatc aatccaccac atccgacgac actcaactcc ccacccctaa
 541 aggagacacc gggagtcctg gaatcaagac tcatccaatg tccatcatgg gtctcaaggt
 601 gaacgtctct gccatattca tggcagtact gttaactctc caaacaccca ccggtcaaat
 661 ccattgggc aatctctcta agatagggt ggtaggaata ggaagtgcaa gctacaaagt
 721 tatgactcgt tccagccatc aatcattagt cataaaatta atgcccaata taactctcct
 781 caataactgc acgagggtag agattgcaga atacaggaga ctactgagaa cagttttgga
 841 accaattaga gatgcactta atgcaatgac ccagaatata agaccgtttc agagtgtagc
 901 ttcaagtagg agacacaaga gatttgcggg agtagtcctg gcaggtgcgg ccctaggcgt
 961 tgccacagct gctcagataa cagccggcat tgccacttcac cagtccatgc tgaactctca
1021 agccatcgac aatctgagag caagtctgga aactactaat caggcaattg aggcaatcag
1081 acaagcaggg caggagatga tattgcctgt tcagggtgtc caagactaca tcaataatga
1141 gctgatacg tctatgaacc aactatcttg tgatttaatc ggccagaagc tcgggctcaa
1201 attgctcaga tactatacag aaatcctgtc attatttggc cctagcttac gggaccccat
1261 atctgcggag atatctatcc aggctttgag ctatgcgctc ggaggagata tcaataaggt
1321 gttagaaaag ctcggatata gcggaggtga tttactgggc atcttagaga cagaggaat
1381 aaaggcccgg ataactcacg tgacacaga gtcctacttc attgtcctca gtatagctta
1441 tccgacgctg tccagatca aggggtgat tgtccaccgg ctcgaggggg tctcgtacaa
1501 cataggctct caagagtggt atacgactgt gcccaagtat gttgcaaccc aagggtacct
1561 tatctcgaat tttgatgagt catcgtgtac ttttatgcca gaggggactg tgtgcagcca
1621 aaatgccttg tacccgatga gtcctctgct ccaagaatgc ctccgggggt ccaccaagtc
1681 ctgtgctcgt acactcgtat ctgggtcttt tgggaaccgg tttatttgt cacaagggaa
1741 cctaatagcc aattgtgcat cgatcctttg caagtgttac acaacaggaa cgatcattaa
1801 tcaagaccct gacaagatcc taacatacat tgctgcagat cactgccgg tagtcgaagt
1861 gaacggcgtg accatccaag tgggagcag gaggtatcca gacgctgtgt acttgcacag
1921 aattgacctc ggtcctccca tcattggga gaggttggac gtagggacaa atctggggaa
1981 tgcaattgct aagttggagg atgccaaaga attgttggag tcatcggacc agatattgag
2041 gagtatgaaa ggttgtcga gcactagcat agtctacatc ctgattgcag tgtgtcttgg
2101 agggttgata gggatcccg ctttaatatg ttgctgcagg gggcgttgta caaaaaggg
2161 agaacaagtt ggtatgtcaa gaccaggcct aaagcctgat cttacaggaa catcaaaatc
2221 ctatgtaagg tcgctctgat cctctacaac tcttggaaca caaatgtccc acaagtctcc
2281 tcttcgtcat caagcaacca ccgcatccag catcaagccc acctgaaatt atctccggct
2341 tccctttggc cgaacaatat cggcagttaa ttaaaactta ggg
```

FIG. 35B

SYKVMTRSSHQSLVIKLMPNITLLNNCTRVEIAEYRRLLRTVLEPIRDALNAMTQNIR
PVQSVASSRRHKRFAGVVLAGAALGVATAAQITAGIALHQSMLNSQAIDNLRASLETT
NQAIEAIRQAGQEMILAVQGVQDYINNELIPSMNQLSCDLIGQKLGLKLLRYYTEILS
LFGPSLRDPISAEISIQALSYALGGDINKVLEKLGYSGGDLLGILESRGIKARITHVD
TESYFIVLSIAYPTLSEIKGVIVHRLEGVSYNIGSQEWYTTVPKYVATQGYLISNFDE
SSCTFMPEGTVCSQNALYPMSPLLQECLRGSTKSCARTLVSGSFGNRFILSQGNLIAN
CASILCKCYTTGTIINQDPDKILTYIAADHCPVVEVNGVTIQVGSRRYPDAVYLHRID
LGPPISLERLDVGTNLGNAIAKLEDAKELLESSDQILRSMKGLSSTSIVYILIAVCLG
GLIGIPALICCCRGRCNKKGEQVGMSRPGLKPDLTGTSKSYVRSL

FIG. 36A

```
   1 tcgagggcca aggaacatac acacccaaca gaacccagac cccggcccac ggcgccgcgc
  61 ccccaaccec cgacaaccag agggagcccc caaccaatcc gccggctccc ccggtgccca
 121 caggcaggga caccaacccc cgaacagacc cagcacccaa ccatcgacaa tccaagacgg
 181 ggggccccc ccaaaaaaaa ggcccccagg ggccgacagc cagcaccgcg aggaagccca
 241 cccaccccac acacgaccac ggcaaccaaa ccagaaccca gaccaccctg ggtcaccagc
 301 tccagacctc ggtcatcacc ccgcagaaag gaaaggcaca acccgcgacc ccagccccga
 361 tccggcgggg agccacccaa cccgaaccag cacccaagag cgatccccga aggaccccg
 421 aaccgcaaag gacatcagta tcccacagcc tctccaagtc ccccggtctc ctcctcttct
 481 cgaagggacc aaaagatcaa tccaccacca cacacccgac gacactcaac tccccacccc
 541 taaggagac accgggaatc cagaatcaa gactcatcca atgtccatca tgggtctcaa
 601 ggtgaacgtc tctgccatat tcatggcagt actgttaact ctccaaacac ccaccggtca
 661 aatccattgg ggcaatctct ctaagatagg ggtggtagga ataggaagtg caagctacaa
 721 agttatgact cgttccagcc atcaatcatt agtcataaaa ttaatgccca atataactct
 781 cctcaataac tgcacgaggg tagagattgc agaatacagg agactactga aacagttt
 841 ggaaccaatt agagatgcac ttaatgcaat gacccagaat ataagaccgg ttcagagtgt
 901 agcttcaagt aggagacaca agagatttgc gggagtagtc ctggcaggtg cggccctagg
 961 cgttgccaca gctgctcaga taacagccgg cattgcactt caccagtcca tgctgaactc
1021 tcaagccatc gacaatctga gagcgagcct ggaaactact aatcaggcaa ttgaggcaat
1081 cagacaagca gggcaggaga tgatattggc tgttcagggt gtccaagact acatcaataa
1141 tgagctgata ccgtctatga accaactatc ttgtgattta atcggccaga agctcgggct
1201 caaattgctc agatactata cagaaatcct gtcattattt ggccccagct acgggaccc
1261 catatctgcg gagatatcta tccaggcttt gagctatgcg cttggaggag acatcaataa
1321 ggtgttagaa aagctcggat acagtggagg tgatttactg ggcatcttag agagcagagg
1381 aataaaggcc cggataactc acgtcgacac agagtcctac ttcattgtcc tcagtatagc
1441 ctatccgacg ctgtccgaga ttaaggggt gattgtccac cggctagagg gggtctcgta
1501 caacataggc tctcaagagt ggtataccac tgtgcccaag tatgttgcaa cccaagggta
1561 ccttatctcg aattttgatg agtcatcgtg tactttcatg ccagagggga ctgtgtgcag
1621 ccaaaatgcc ttgtacccga tgagtcctct gctccaagaa tgcctccggg gtccaccaa
1681 gtcctgtgct cgtacactcg tatccgggtc ttttgggaac cggttcattt tatcacaagg
1741 gaacctaata gccaattgtg catcaatcct ttgcaagtgt tacacaacag aacgatcat
1801 taatcaagac cctgacaaga tcctaacata cattgctgcc gatcactgcc cggtagtcga
1861 ggtgaacggc gtgaccatcc aagtcgggag caggaggtat ccagacgctg tgtacttgca
1921 cagaattgac ctcggtcctc ccatatcatt ggagaggttg gacgtaggga caaatctggg
1981 gaatgcaatt gctaagttgg aggatgccaa ggaattgttg gagtcatcgg accagatatt
2041 gaggagtatg aaaggtttat cgagcactag catagtctac atcctgattg cagtgtgtct
2101 tggagggttg atagggatcc ccgctttaat atgttgctgc aggggcgtt gtaacaaaaa
2161 gggagaacaa gttggtatgt caagaccagg cctaaagcct gatcttacgg gaacatcaaa
2221 atcctatgta aggtcgctct gatcctctac aactcttgaa acacaaatgt tcccacaagt
2281 ctcctcttcg tcatcaagca accaccgcac ccagcatcaa gcccacctga ccagctaaa
2341 ttatctccgg cttccctctg gccgaacaat atcggtagtt aat
```

FIG. 36B

MSIMGLKVNVSAIFMAVLLTLQTPAGQIHWGNLSKIGVVGIGSA
SYKVMTRSSHQSLVIKLIPNITLLNNCTRVEIAEYRRLLRTVLEPIRDALNAMTQNIR
PVQSVASSMRHKRFAGVVLAGAALGVATAAQITAGIALHRSMLNSQAIDNLRASLETT
NQAIEAIRQAGQEMILAVQGVQDYINNELIPSMNQLSCDLIGQKLGLKLLRYYTEILS
LFGPSLRDPISAEISIQALSYALGGDINKVLEKLGYSGGDLLGILESRGIKARITHVD
TESYFIVLSIAYPTLSEIKGVIVHRLEGVSYNIGSQEWYTTVPKYVATQGYLISNFDE
SSCTFMPEGTVCSQNALYPMSPLLQECLRGSTKSCARTLVSGSFGNRFILSQGNLIAN
CASILCKCYTTGTIINQDPDKILTYIAADHCPVVEVNGVTIQVGSRRYPDAVYLHRID
LGPPISLERLDVGTNLGNAIAKLEDAKELLESSDQILRSMKGLSSTSIVYILIAVCLG
GLIGIPTLICCCRGRCNKKGEQVGMSRPGLKPDLTGTSKSYVRSL

FIG. 37A

```
   1 atgtccatca tgggtctcaa ggtgaacgtc tctgccatat tcatggcagt actgttaact
  61 ctccaaacac ccgccggtca aatccattgg ggcaatctct ctaagatagg ggtagtagga
 121 ataggaagtg caagctacaa agttatgact cgttccagcc atcaatcatt agtcataaaa
 181 ttaattccca atataactct cctcaataac tgcacgaagg tagagattgc agagtacagg
 241 agactactaa gaacagtttt ggaaccaatt agagatgcac ttaatgcaat gacccagaac
 301 ataaggccgg ttcagagcgt agcttcaagt atgagacaca agagatttgc gggagtagtc
 361 ctggcaggtg cggccctagg cgttgccaca gctgctcaga taacagccgg cattgcactt
 421 caccggtcca tgctgaactc tcaagccatc gacaatctga gagcagcct ggaaactact
 481 aatcaggcaa tgaggcaat cagacaagca gggcaggaga tgatcttgc tgttcagggg
 541 gtccaagact acatcaataa tgagctgata ccatctatga accagctatc ttgtgattta
 601 atcgggcaga agctcgggct caaattgctc agatactata cagaaatcct gtcattattt
 661 ggccccagcc tacgagaccc catatctgcg agatatctta ccaggccttt gagctatgca
 721 cttggaggag atatcaataa ggtgttagaa aagctcggat acagtggagg cgatttactg
 781 ggcatcttag agagcagagg aataaaggct cggataactc acgtcgacac agagtcctac
 841 ttcattgtcc tcagtatagc ctatccgaca ctgtccgaga ttaaggggt gattgtccat
 901 cggctagagg gggtctcgta caacataggc tctcaagagt ggtataccac tgtgcccaag
 961 tatgttgcaa cccaagggta ccttatctcg aattttgatg agtcatcgtg taccttcatg
1021 ccagagggga ctgtgtgcag ccaaaatgcc ttgtacccga tgagtcctct gctccaagaa
1081 tgcctccggg ggtccaccaa gtcctgtgct cgtacactcg tatccgggtc ttttgggaac
1141 cggttcattt tatcacaagg gaacctaata gccaattgtg catcaattct ttgcaagtgt
1201 tacacaacag gaacgatcat taatcaagac cctgacaaga ttctaacata catcgctgcc
1261 gatcgctgcc cggtagtcga ggtaaacggc gtgaccatcc aagtcgggag caggaggtat
1321 ccagacgctg tgtatttgca cagaattgac ctcggtcctc ccatatcatt ggagaggttg
1381 gacgtaggga caaatctggg gaatgcaatt gccaaattgg aggatgccaa ggaattgttg
1441 gagtcatcgg accagatatt gaggagtatg aaggtttat cgagcactag catagtctac
1501 atcctgattg cagtgtgtct tggagggctg ataggatcc ccactttaat atgttgctgc
1561 aggggggcgtt gtaacaaaaa gggagaacaa gttggtatgt caagaccagg cctaaagcct
1621 gatcttacag gaacatcaaa atcatatgta aggtcgctct ga
```

FIG. 37B

MATLLRSLALFKRNKDKPPITSGSGGAIRGIKHIIIVPIPGDSS
ITTRSRLLDRLVRLIGNPDVSGPKLTGALIGILSLFVESPGQLIQRITDDPDVSIRLL
EVVQSDQSQSGLTFASRGTNMEDEADQYFSHDDPSSSDQSRFGWFENKEISDIEVQDP
EGFNMILGTILAQIWVLLAKAVTAPDTAADSELRRWIKYTQQRRVVGEFRLERKWLDV
VRNRIAEDLSLRRFMVALILDIKRTPGNKPRIAEMICDIDTYIVEAGLASFILTIKFG
IETMYPALGLHEFAGELSTLESLMNLYQQMGETAPYMVILENSIQNKFSAGSYPLLWS
YAMGVGVELENSMGGLNFGRSYFDPAYFRLGQEMVRRSAGKVSSTLASELGITAEDAR
LVSEIAMHTTEDRISRAVGPRQSQVSFLHGDQNENELPRWGGKEDMRVKQSRGEARES
YRETRPSRASDARATHPPTDTPLDIDTASESSQDPQDSRRSADALLRLQAMAGISEEQ
GSDTDTPRVYNDRDLLD

FIG. 38A

```
   1 aggattcaag atcctattat cagggacaag agcaggatta gggatatccg agatggccac
  61 acttctaagg agcttagcat tgttcaaaag aaacaaggac aaaccaccca ttacatcagg
 121 atccggtgga gccatcagag gaatcaaaca cattattata gtaccaatcc cgggagattc
 181 ctcaattacc actcgatcta gacttctgga ccggttggtc aggttaattg aaacccgga
 241 tgtgagcggg cccaaactaa caggggcact aataggtata ttatccttat tgtggagtc
 301 tccaggtcaa ttgattcaga ggatcaccga tgaccctgac gttagcataa ggctgttaga
 361 ggttgtccag agtgaccagt cacaatctgg ccttaccttc gcatcaagag gtaccaacat
 421 ggaggatgag gcggaccaat attttcaca tgatgatcca agtagtagtg atcaatccag
 481 gttcggatgg ttcgagaaca aggaaatctc agatattgaa gtgcaagacc ctgagggatt
 541 caacatgatt ctgggtacca tcctagctca aatttgggtc ttgctcgcaa aggcggttac
 601 ggccccagac acggcagctg attcggagct aagaaggtgg ataaagtaca cccaacaaag
 661 aagggtagtt ggtgaattta gattggagag aaaatggttg gatgtggtga ggaacaggat
 721 tgccgaggac ctctccttac gccgattcat ggtcgctcta atcctggata tcaagagaac
 781 acccgggaac aaacccagga ttgctgaaat gatatgtgac attgatacat atatcgtaga
 841 ggcaggatta gccagtttta tcctgactat taagtttggg atagaaacta tgtatcctgc
 901 tcttggactg catgaatttg ctggtgagtt atccacactt gagtccttga tgaatcttta
 961 ccagcaaatg ggggaaactg caccatacat ggtaatcctg agaactcaa ttcagaacaa
1021 gttcagtgca ggatcatacc ctctgctctg gagctatgcc atgggagtag gagtggaact
1081 tgaaaactcc atgggaggtt tgaactttgg ccgatcttac ttcgatccag catattttag
1141 actagggcaa gagatggtga ggaggtcagc tggaaaggtc agttccacat ggcatctga
1201 actcggtatc actgccgaag atgcaaggct tgtttcagag atcgcaatgc atactacaga
1261 ggacaggatc agtagagcgg ttggacccag acaatcccaa gtgtcattcc tacacggtga
1321 tcaaaatgaa aatgagctac cgagatgggg gggtaaggaa gatatgaggg tcaaacagag
1381 tcggggagaa gccagagaga gctacagaga aaccaggccc agcagagcaa gtgacgcgag
1441 agctacccat cctccaaccg acacacct agacattgac actgcatcgg agtccagcca
1501 agatccgcag gacagtcgaa ggtcagctga cgccctgctc aggctgcaag ccatggcagg
1561 aatctcggaa gaacaaggct cagacacgga caccctaga gtgtacaatg acagagatct
1621 tctagactag gtgcaagagg ccgaggacca gaacaacatc cgcctaccct ccatcattgt
1681 tataa
```

FIG. 38B

MATLLRSLALFKRNKDKPPITSGSGGAIRGIKHIIIVPIPGDSS
ITTRSRLLDRLVRLIGNPDVSGPKLTGALIGILSLFVESPGQLIQRITDDPDVSIRLL
EVVQSDQSQSGLTFASRGTNMEDEADQYFLHDDSSSGDQFRSGWFENKEISDIEVQDP
EGFNMILGTILAQIWVLLAKAVTAPDTAADSELRRWIKYTQQRRVVGEFRLERKWLDV
VRNRIAEDLSLRRFMVALILDIKRTPGNKPRIAEMICDIDTYIVEAGLASFILTIKFG
IETMYPALGLHEFAGELSTLESLMNLYQQMGETAPYMVILENSIQNKFSAGSYPLLWS
YAMGVGVELENSMGGLNFGRSYFDPAYFRLGQEMVRRSAGKVSSTLASELGITAEDAR
LVSEIAMHTTEDRISRAVGPRQAQVSFLHGDQSENELPGLGGKEDKRVKQSRGEARES
YRETGHSRANDARAADLPTDTPLDIDTASESSQDPQDSRRSADALLRLQAMAGIPEEQ
GSDMDTPRVYNDRDLLD

FIG. 39A

```
   1 atggccacgc tattaaggag cttagcattg ttcaaaagaa acaaggacaa accacccatt
  61 acatcaggat ccggtggggc catcagaggg atcaaacaca ttattatagt accaatccct
 121 ggagactcct caattaccac tcgatccaga cttctggacc ggttggtcag gctaattgga
 181 aacccggatg tgagtgggcc taaattaaca ggggcactaa taggtatatt gtccttattt
 241 gtggagtctc caggtcaatt gattcagaga atcaccgatg accctgacgt tagcataagg
 301 ctgttagagg ttgtccagag cgaccagtca aatctggcc ttacctttgc atcaagaggt
 361 accaacatgg aggatgaggc ggaccaatac ttttacatg atgattcaag tagcggtgat
 421 caattcaggt ccggatggtt cgagaacaag gaaatctcag atattgaagt gcaggaccct
 481 gagggattca acatgattct gggtaccatc ctagctcaaa tttgggtctt gctcgcaaag
 541 gcggttacgg ccccagacac ggcagctgat cggagctaa aaggtggat aaaatacacc
 601 caacaaagaa gggtagtcgg tgaattcaga tggagagaa atggttgga tgtagtgagg
 661 aacaggattg ccgaggacct ctccttacgc cggttcatgg tcgctctaat cctggatatc
 721 aagagaacac ccgggaacaa acccaggatt gctgaaatga tatgtgacat tgacacatat
 781 atcgtggagg caggattagc cagttttatc cttactatta gtttgggat agaaaccatg
 841 tatcctgctc ttggactgca tgaatttgct ggtgagttat caacacttga gtccttgatg
 901 aacctttatc agcaaatggg ggaaactgca ccctacatgg tcattctgga gaactcaatt
 961 cagaacaagt tcagtgcagg atcataccct ctgctctgga gctatgccat gggagtagga
1021 gtggaactcg aaaactccat gggaggtttg aactttggcc gatcttactt tgatccagca
1081 tattttagat taggacaaga gatggtcagg aggtcagctg gaaggtcag ttccacattg
1141 gcatctgaac tcggtatcac ggccgaggat gcaaggcttg tttcagagat tgcaatgcat
1201 actactgagg acaggatcag tagagcggtt ggacccaggc aagcccaagt gtcatttcta
1261 cacggtgatc aaagtgagaa tgagctaccg ggattgggag gtaaggaaga taagagagtc
1321 aaacagagtc gaggagaagc cagggagagc tatagagaaa ctgggcacag cagagcaaat
1381 gatgcgagag ctgctgacct tccaaccggc acacccctag acattgacac tgcatcggag
1441 tcagccaag acccacagga cagtcgaagg tcagctgacg ccctgctcag gctgcaagcc
1501 atggcaggga tcccggaaga acaaggctca gacatggaca cccctagagt gtacaatgac
1561 agagatcttc tagactag
```

FIG. 39B

MATLLRSLALFKRNKDKPPITSGSGGAIRGIKHIIIVPIPGDSS
ITTRSRLLDRLVRLIGNPDVSGPKLTGALIGILSLFVESPGQLIQRITDDPDVSIRLL
EVVQSDQSQSGLTFASRGTNMEDEADQYFSHDDPISSDQSRFGWFENKEISDIEVQDP
EGFNMILGTILAQIWVLLAKAVTAPDTAADSELRRWIKYTQQRRVVGEFRLERKWLDV
VRNIIAEDLSLRRFMVALILDIKRTPGNKPRIAEMICDIDTYIVEAGLASFILTIKFG
IETMYPALGLHEFAGELSTLESLMNLYQQMGKPAPYMVNLENSIQNKFSAGSYPLLWS
YAMGVGVELENSMGGLNFGRSYFDPAYFRLGQEMVRRSAGKVSSTLASELGITAEDAR
LVSEIAMHTTEDRISRAVGPRQAQVSFLQGDQSENELPRLGGKEDRRVKQSRGEARES
YRETGPSRASDARAAHLPTGTPLDIDTASESSQDPQDSRRSAEPLLSCKPWQESRKNK
AQTRTPLQCTMTEIF

FIG. 40A

```
   1 atggccacgc ttttaaggag cttagcattg ttcaaaagaa acaaggacaa accacccatt
  61 acatcaggat ccggtggagc catcagagga atcaaacaca ttattatagt accaatccct
 121 ggagattcct caattaccac tcgatccaga cttctggacc ggttggtcag gttaattgga
 181 aacccggatg tgagcgggcc caaactaaca ggggcactaa taggtatatt gtccttattt
 241 gtggagtctc caggtcaatt gattcagagg atcaccgatg accctgacgt tagcataagg
 301 ctgttagagg ttgtccagag tgaccagtca caatctggcc ttaccttcgc atcaagaggt
 361 accaacatgg aggatgaggc ggaccaatac ttttcacatg atgatccaat tagcagtgat
 421 caatccaggt tcggatggtt cgagaacaag gaaatctcag atattgaagt gcaagaccct
 481 gagggattca acatgattct gggtaccatc ctagcccaaa tttgggtctt gctcgcaaag
 541 gcggttacgg ccccagacac ggcagctgat tcggagctaa gaaggtggat aaagtacacc
 601 caacaaagaa gggtagttgg tgaatttaga ttggagagaa aatggttgga tgtggtgagg
 661 aacattattg ccgaggacct ctccttacgc cgattcatgg tcgctctaat cctggatatc
 721 aagagaacac ccggaaacaa acccaggatt gctgaaatga tatgtgacat tgatacatat
 781 atcgtagagg caggattagc cagttttatc ctgactatta gtttgggat agaaactatg
 841 tatcctgctc ttggactgca tgaatttgct ggtgagttat caacacttga gtccttgatg
 901 aaccttacc agcaaatggg gaaacctgca ccctacatgg tcaacctgga gaactcaatt
 961 cagaacaagt tcagtgcagg atcataccct ctgctctgga gctatgccat gggagtagga
1021 gtggaacttg aaaactccat gggaggtttg aactttggcc gatcttactt tgatccagca
1081 tatttagat tagggcaaga gatggtaagg aggtcagctg aaaggtcag ttccacatta
1141 gcatctgaac tcggtatcac tgccgaggat gcaaggcttg tttcagagat tgcaatgcat
1201 actactgagg acaagatcag tagagcggtt ggacccagac aagcccaagt atcatttcta
1261 cagggtgatc aaagtgagaa tgagctaccg cgattggggg gcaaggaaga taggagggtc
1321 aaacagagtc gaggagaagc cagggagagc tacagagaaa ccgggcccag cagagcaagt
1381 gatgcgagag ctgcccatct tccaaccggc acaccctag acattgacac tgcatcggag
1441 tccagccaag atccgcagga cagtcgaagg tcagctgagc cctgcttag ctgcaagcca
1501 tggcaggaat ctcggaagaa caaggctcag acacggacac cctacagtg tacaatgaca
1561 gaaatcttct agactaggtg cgagaggccg agggccagaa caacatccgc ctaccctcca
1621 tcattgttat a
```

FIG. 40B

MHMFPLGVVEDSDPPGPPIGRASGSPPPGAGRSTAKPEELLKEA
TEANIVVRRTAGLNEKLAFHNNTPPTLPTPRRKAPTTGSVLNANQACNAVNLAPLDTP
QRFRVVYMSITRPLDNGYYTVPRRMLEFRSVNAVAFNLLVTLRIDKAIGPGKIIDNAE
QLPEATFMVHIGDFRRKKSEVYSADYCKMKIEKMGLVFALGGIGGTSLHTRSTGKMSK
TLHAQLGFKKTSCYPPMDINEDLNRLLWRSRCKIVRIQAVLQPSVPQELRIYDDVIIN
DDQGVFKVLQTVVPSNARKRPPSQ

FIG. 41A

```
   1 aggagcaaag tgattgcctc ccaagctcca caacgacaga gatccacgac ctcgacaagt
  61 cggcatggga catcaagggg tcgatcgctc cgacacaacc caccacccac agtgatggca
 121 ggctggtgcc ccaggccaga gccacagatc ctggtctagg cgacaggaag ggcgaacgcc
 181 ccatgcacat gtttccgctg ggggtcgttg aggacagcga cccccaggg cctccaatcg
 241 ggcgagcatc cgggtccccg cccccaggcg ctggcagatc cacagcaaaa cccgaagaac
 301 tcctcaaaga ggccaccgag gccaacatag tcgtcagacg cacagcaggg ctcaacgaaa
 361 aactggcgtt ccacaacaat ccccaccaa ctctccccac accccggaga aaggccccaa
 421 caacagggag cgtcctcaac gcaaaccaag cgtgcaatgc ggtcaatctg gcaccgctgg
 481 acaccccgca gaggttccgt gttgtctaca tgagcatcac ccgtcccttg gacaacgggt
 541 actacaccgt tcccagaaga atgctggaat tcaggtcggt caatgcagtg gccttcaacc
 601 tgctggtgac ccttagaatt gacaaggcga ttggccctgg gaagatcatc gacaatgcag
 661 agcaacttcc tgaggcaaca ttcatggtcc acatcgggga cttcaggaga aagaagagcg
 721 aagtctactc tgccgactat tgcaagatga aaatcgaaaa gatgggcctg gttttttgcac
 781 ttggtgggat aggggggcacc agtcttcaca ctagaagcac aggcaaaatg agcaagactc
 841 tccatgcaca actcgggttc aagaagacct catgttaccc accaatggat atcaatgaag
 901 acctcaatcg actactctgg aggagcagat gcaagatagt aagaatccag gcagttctgc
 961 agccatcagt tccccaagaa ctccgcattt acgacgacgt gatcataaat gatgaccaag
1021 gagtattcaa agttctgcag accgtggtgc ccagcaatgc cgaaaacga ccccccctcac
1081 aatgacagcc aaaaggcccg gacaaaaaaa ccccccccga aaaactccac ggaccaagcg
1141 agaggccagc cagcagctga cggcaagcgc gaacaccagg cggccccagc acagaacagc
1201 cccgacacaa ggccaccacc agccagccca atctgcatcc tcctcgtggg accccggagg
1261 accaaccccc aaagttgccc ccgacccaaa ccaccaaccg catccccacc acccctggga
1321 aagaaacccc cagcaactgg aaggccccctt ccccctccc tcaacacaag aaccccacaa
1381 ccgaaccgca caagcgaccg aggtgaccca accgcaggca cccgactccc tagatagatc
1441 ctctccccc gggc
```

FIG. 41B

MHMFPLGVVEDSDPPGPPIGRASGSPPPGAGRSTAKPEELLKEA
TEANIVVRRTAGLNEKLAFHNNTPPTLPTPRRKAPTTGSVLNANQACNAVNLAPLDTP
QRFRVVYMSITRPLDNGYYTVPRRMLEFRSVNAVAFNLLVTLRIDKAIGPGKIIDNAE
QLPEATFMVHIGDFRRKKSEVYSADYCKMKIEKMGLVFALGGIGGTSLHTRSTGKMSK
TLHAQLGFKKTSCYPPMDINEDLNRLLWRSRCKIVRIQAVLQPSVPQELRIYDDVIIN
DDQGVFKVLQTVVPSNARK

FIG. 42A

```
   1 aggagcaaag tgattgcctc ccaagctcca caacgacaga gatccacgac ctcgacaagt
  61 cggcatggga catcaagggg tcgatcgctc cgacacaacc caccacccac agtgatggca
 121 ggctggtgcc ccaggccaga gccacagatc ctggtctagg cgacaggaag ggcgaacgcc
 181 ccatgcacat gtttccgctg ggggtcgttg aggacagcga cccccagggg cctccaatcg
 241 ggcgagcatc cgggtccccg ccccaggcg ctgcagatc cacagcaaaa cccgaagaac
 301 tcctcaaaga ggccaccgag gccaacatag tcgtcagacg cacagcaggg ctcaacgaaa
 361 aactggcgtt ccacaacaat accccaccaa ctctccccac accccggaga aaggccccaa
 421 caacagggag cgtcctcaac gcaaaccaag cgtgcaatgc ggtcaatctg gcaccgctgg
 481 acaccccgca gaggttccgt gttgtctaca tgagcatcac ccgtcccttg gacaacgggt
 541 actacaccgt tcccagaaga atgctggaat tcaggtcggt caatgcagtg gccttcaacc
 601 tgctggtgac ccttagaatt gacaaggcga ttggccctgg gaagatcatc gacaatgcag
 661 agcaacttcc tgaggcaaca ttcatggtcc acatcgggga cttcaggaga aagaagagcg
 721 aagtctactc tgccgactat tgcaagatga aaatcgaaaa gatgggcctg gttttttgcac
 781 ttggtgggat aggggcacc agtcttcaca ctagaagcac aggcaaaatg agcaagactc
 841 tccatgcaca actcgggttc aagaagacct catgttaccc accaatggat atcaatgaag
 901 acctcaatcg actactctgg aggagcagat gcaagatagt aagaatccag gcagttctgc
 961 agccatcagt tccccaagaa ctccgcattt acgacgacgt gatcataaat gatgaccaag
1021 gagtattcaa agttctgcag accgtggtgc ccagcaatgc ccgaaaatga ccccccctcac
1081 aatgacaacc aaaaggcccg gacaaaaaaa cccccccga aaaactccac ggaccaagcg
1141 agaggccagc cagcagctga cggcaagcgc gaacaccagg cggcccagc acagaacagc
1201 cccgacacaa ggccaccacc agccagccca atctgcatcc tcctcgtggg accccggagg
1261 accaaccccc aaagttgccc ccgacccaaa ccaccaaccg catcccacc accccgggga
1321 aagaaacccc cagcaactgg aaggccccctt cccccctccc tcaacacaag aaccccacaa
1381 ccgaaccgca caagcgaccg aggtgaccca accgcaggca cccgactccc tagatagatc
1441 ctctccccc gggc
```

FIG. 42B

MTEIYDFDKSAWDIKGSIAPIQPTTYSDGRLVPQVRVIDPGLGD
RKDECFMYMFLLGVVEDSDSLGPPIGRAFGSLPLGVGRSTAKPEKLLKEATELDIVVR
RTAGLNEKLVFYNNTPLTLLTPWRKVLTTGSVFNANQVCNAVNLIPLDTPQRFRVVYM
SITRLSDNGYYTVPRRILEFRSVNAVAFNLLVTLRIDKAIGPGKIIDNTEQLPEATFM
VHIGNFMRNKSEVYSADYCKMKIEKMGLVFALGGIGGTSLHIRSTGKMSKTLHAQLGF
KKTLCYPLIDINEDLNRLLWRSRCKIVRIQAVLQPSVPQEFRIYDDVIINDDQGLFKV
L

FIG. 43A

```
  1 atgacagaga tctacgactt cgacaagtcg gcatgggaca tcaaagggtc gatcgctccg
 61 atacaaccca ccacctacag tgatggcagg ctggtgcccc aggtcagagt catagatcct
121 ggtctaggcg acaggaagga tgaatgcttt atgtacatgt ttctgctggg ggttgttgag
181 gacagcgatt ccctagggcc tccaatcggg cgagcatttg gtccctgcc cttaggtgtt
241 ggcagatcca cagcaaagcc cgaaaaactc ctcaaagagg ccactgagct tgacatagtt
301 gttagacgta cagcagggct caatgaaaaa ctggtgttct acaacaacac cccactaact
361 ctcctcacac cttggagaaa ggtcctaaca acaggagtg tcttcaacgc aaaccaagtg
421 tgcaatgcgg ttaatctgat accgctcgat accccgcaga ggttccgtgt tgtttatatg
481 agcatcaccc gtctttcgga taacgggtat tacaccgttc ctagaagaat actggaattc
541 agatcggtca atgcagtggc cttcaacctg ctggtgaccc ttaggattga caaggcgata
601 ggccctggga agatcatcga atacagag caacttcctg aggcaacatt tatggtccac
661 atcgggaact tcatgagaaa taagagtgaa gtctactctg ccgattattg caaaatgaaa
721 atcgaaaaga tgggcctggt ttttgcactt ggtgggatag ggggcaccag tcttcacatt
781 agaagcacag gcaaaatgag caagactctc catgcacaac tcgggttcaa gaagacctta
841 tgttacccgc tgatagatat caatgaagac cttaatcgat tactctggag gagcagatgc
901 aagatagtaa gaatccaggc agttttgcag ccatcagttc ctcaagaatt ccgcatttac
961 gacgacgtga tcataaatga tgaccaagga ctattcaaag ttctgtag
```

FIG. 43B

MSNHTHQLKFKTLKRAWKASKYFIVGLSCLYKFNLKSLVQTALT
TLAMITLTSLVITAIIYISVGNAKAKPTFKPTIQQTQQPQNHTSPLFTEHNHKSTHTS
IQSTTLSQPLNIDTTRGTTYSHSTDETQNRKNKSQSTLPANRQPPINPSGSNPPENHQ
DHNNSQTLPYVPCSTCKGNLACSSLCQIGLERAPSRAPTITLKRASKPKTTKKPTKTT
THHRTSPEAKLQPKNNTAAPQQGILSSPEHHTDQSTTQI

FIG. 44A

```
  1 atgtccaacc atacccatca acttaaattc aagacattaa agagggcttg gaaagcctca
 61 aaatacttca tagtaggatt atcatgttta tataagttca atttaaaatc ccttgtccaa
121 acggctttga ccaccttagc tatgataacc ttgacatcac tcgtcataac agccattatt
181 tacattagtg tgggaaatgc taaagccaag cccacattca aaccaaccat ccaacaaaca
241 caacagcccc aaaaccatac ctcacctctt ttcacagagc acaaccacaa atcaactcac
301 acatcaatcc aaagcaccac actatcccaa ccactaaaca tagacaccac tagaggaact
361 acatacagtc actcaaccga tgaaacccaa aatagaaaaa acaaaagcca atccactcta
421 cctgccaaca gacaaccacc aatcaaccca tcgggaagca accccctga aaaccaccaa
481 gaccacaaca actcccaaac actcccctat gtgccttgca gtacatgtaa aggcaatctt
541 gcttgctcat cactctgcca aatcgggctg gagagagcac caagcagagc ccccacaatc
601 accctaaaaa gggcgtcaaa acccaaaacc accaaaaaac caaccaagac aacaacccac
661 cacagaacta gccctgaagc caaactgcaa cccaaaaaca acacggcagc tccacaacaa
721 ggcatcctct cttcaccaga gcaccacaca gatcaatcaa ctacacagat ctaa
```

FIG. 44B

MSKNKNQRTARTLEKTWDTLNHLIVISSCLYRLNLKSIAQIADS
VLAMIISTSLIIAAIIFIISANHKVTPTTVTVQTIKNHTEKNITTYLTHVSPERVSPS
KQPTTTLPIHTNSATISPNTKSETHHTTAQTKGIITTPTQTNKPSTKPRPKNPPKKPK
DDYHFEVFNFVPCSICGNNQLCKSICKTIPSNKPKKKPTIKPTNKPTTKTTNKRDPKT
LAKTLKKENTTNPTKKPTLKTTERDTSTPQSTVLDTTTSKHTIQQQSLHSTTPENTPN
STQIPTASEPSTSNSTQKI

FIG. 45A

```
  1 ggggcaaatg caaccatgtc caaaaacaag aatcaacgca ctgccaggac tctagaaaag
 61 acctgggata ctcttaatca tctaattgtg atatcctctt gtttatacag attaaattta
121 aaatctatag cacaaatagc actatcagtt ttggcaatga taatctcaac ctctctcata
181 attgcagcca taatattcat catctctgcc aatcacaaag ttacaccaac aacggtcaca
241 gttcaaacaa taaaaaacca cactgaaaaa acatcacca cttaccttac tcatgtctca
301 ccagaaaggg ttagcccatc caaacaaccc acaaccacac taccaatcca cacaaactca
361 gccacaatat cacctaatac aaaatcagaa acacaccata caacagcaca aaccaaaggc
421 ataatcacca ctccaacaca gaccaacaag ccaagcacaa aaccacgtcc aaaaaatcca
481 ccaaaaaaac aaaagatga ttaccatttt gaagtgttca acttcgttcc ctgtagtata
541 tgtggcaaca accaactttg caaatccatc tgcaaaacaa taccaagcaa caaaccaaag
601 aaaaaaccaa ccatcaaacc cacaaacaaa ccaaccacca aaccacaaa caaaagagac
661 ccaaaaacac tagccaaaac gctgaaaaaa gaaaacacca ccaacccaac aaaaaaacca
721 accctcaaga ccacagaaag agacaccagc actccacaat ccaccgtgct cgacacaacc
781 acatcaaaac acacaatcca acagcaatcc ctccactcaa ccacccccga aaacacaccc
841 aactccacac aaatacccac agcatccgag ccctccacat caaattccac ccaaaaaatc
901 tagtcacatg cttagttatt c
```

FIG. 45B

MSKNKNQRTARTLEKTWDTLNHLIVISSCLYRLNLKSIAQIALS
VLAMIISTSLIIAAIIFIISANHKVTLTTVTVQTIKNHTEKNITTYLTQVSPERVSPS
KQPTTTPPIHTNSATISPNTKSETHHTTAQTKGRITTPTQNNKPSTKPRPKNPPKKPK
DDYHFEVFNFVPCSICGNNQLCKSICKTIPSNKPKKKPTIKPTNKPPTKTTNKRDPKT
LAKTLKKETTTNPTKKPTPKTTEGDTSTPQSTVLDTTTSKHTERDTSTSQSTVLDTTT
SKHTIQQQSLYSTTPENTPNSTQTPTASEPSTSNSTQKL

FIG. 46A

```
  1 ggggcaaatg caaccatgtc caaaaacaag aatcaacgca ctgccaggac tctagaaaag
 61 acctgggata ctcttaatca tctaattgta atatcctctt gtttatacaa attaaattta
121 aaatctatag cacaaatagc actatcagtt ttggcaatga taatctcaac ctctctcata
181 attgcagcca taatattcat catctctgcc aatcacaaag ttacactaac aactgtcaca
241 gttcaaacaa taaaaaacca cactgaaaaa aacatcacca cttaccttac tcaagtctca
301 ccagaaaggg ttagcccatc caaacaaccc acaaccacac caccaatcca cacaaactca
361 gccacaatat cacctaatac aaaatcagaa acacaccata caacagcaca aaccaaaggc
421 agaaccacca ctccaacaca gaacaacaag ccaagcacaa aaccacgtcc aaaaaatcca
481 ccaaaaaaac caaaagatga ttaccatttt gaagtattca acttcgttcc ctgtagtata
541 tgtggcaaca accaactctg caaatccatc tgcaaaacaa taccaagcaa taaaccaaag
601 aaaaaaccaa ccataaaacc cacaaacaaa ccacccacca aaccacaaa caaaagagac
661 ccaaaaactc tagccaaaac actgaaaaaa gaaaacacca tcaacccaac aaaaaaacca
721 acccccaaga ccacagaagg agacaccagc acctcacaat ccactgtgct cgacacaacc
781 acatcaaaac acacagaaag agacaccagc acctcacaat ccactgtgct aaacacaccc
841 acctccaaac acacaatcca acagcaatcc ctctactcaa ccaccoctga aaacacaccc
901 aactccacac aaacacccac agcatccgag ccctccacat caaattccac ccaaaaactc
961 tagtcatatg cttagttatt c
```

FIG. 46B

MELPILKTNAITTILAAVTLCFASSQNITEEFYQSTCSAVSKGY
LSALRTGWYTSVITIELSNIKENKCNGTDAKAKLIKQELDKYKNAVTELQLLMQSTPA
ANNRARRELPRFMNYTLNNTKNTNVTLSKKRKRRFLGFLLGVGSAIASGIAVSKVLHL
EGEVNKIKSALLSTNKAVVSLSNGVSVLTSKVLHLKNYIDKQFLPIVNKQSCSISNIA
TVIEFQQKNNRLLEITREFSVNAGVTTPVSTYMLTNSELLSLINDMPITNDQKKLMSN
NVQIVRQQSYSIMSIIKEEVLAYVVQLPLYGVMDTPCWKLHTSPLCTTNTKEGSNICL
TRTDRGWYCDNAGSVSFFPQAETCKVQSNRVFCDTMSSLTLPSEVNLCNIDIFNPKYD
CKIMTSKTDVSSSVITSLGAIVSCYGKTKCTASNKNRGIIKTFSNGCDYVSNKGVDTV
SVGNTLYYVNKQEGKSLYVKGEPIINFYDPLVFPSDEFDASISQVNEKINQSLAFIRK
SDELLHNVNAGKSTINIMITTIIVIIVILLSLIAVGLLLYCKARSTPVTLSKDQLSG
INNIAFSS

FIG. 47A

```
   1 cgcgcaaata acaatggagt tgccaatcct caaaacaaat gctattacca caatccttgc
  61 tgcagtcaca ctctgtttcg cttccagtca aacatcact gaagaatttt atcaatcaac
 121 atgcagtgca gttagcaaag gctatcttag tgctctaaga actggttggt atactagtgt
 181 tataactata gaattaagta atattaaaga aaataagtgt aatggaacag acgccaaggc
 241 aaaattgata aacaagaat tagataaata taaaaatgct gtaacagaat tgcagttgct
 301 catgcaaagt actccagcag ccaacaatcg agccagaaga gaactaccaa ggtttatgaa
 361 ttatacactc aacaatacca aaaacaccaa tgtaacatta agcaagaaaa ggaaaagaag
 421 atttcttggt tttttgttag gtgttggatc tgcaatcgcc agtggcattg ccgtatccaa
 481 ggtcctacac ctagaagggg aagtgaacaa aatcaaaagt gctctactat ccacaaacaa
 541 ggctgtagtc agcttatcaa atggagtcag tgttttaacc agcaaagtgt tacatctcaa
 601 aaactatata gataaacagt tcttacctat tgtgaacaag caaagctgca gcatatcaaa
 661 cattgcgact gtgatagagt tccaacaaaa gaacaacaga ctactagaga ttaccaggga
 721 atttagtgtt aatgcaggcg taactacacc tgtaagtact tatatgttaa ctaatagtga
 781 attattatca ttaatcaatg atatgcctat aacaaatgat cagaaaaagt taatgtccaa
 841 caatgtccaa atagttagac agcaaagtta ctctatcatg tccataataa aggaggaagt
 901 cttagcatat gtagtacaat taccactata tggtgtaatg gatacacctt gttggaaact
 961 gcacacatcc cctctatgta caaccaacac aaaggaaggg tccaacatct gcttaacaag
1021 aaccgacaga ggatggtact gtgacaatgc aggatcagta tcttcttcc cacaagctga
1081 aacatgtaaa gttcaatcga atcgggtatt tgtgacaca atgaacagtt taacattacc
1141 aagtgaggta aatctctgca acattgacat attcaacccc aaatatgatt gtaaaattat
1201 gacttcaaaa acagatgtaa gcagctccgt tatcacatct ctaggagcca ttgtgtcatg
1261 ctatggcaaa actaaatgta gcagcatcaa taaaaatcgt gggatcataa agacattttc
1321 taacgggtgt gattatgtat caaataaggg ggtggatact gtgtctgtag gtaatacatt
1381 atattatgta aataagcaag aaggcaaaag tctctatgta aaaggtgaac caataataaa
1441 tttctatgac ccattagtgt tccctctga tgaatttgat gcatcaatat ctcaagtcaa
1501 tgagaagatt aaccagagtc tagcatttat tcgtaaatca gatgaattat tacataatgt
1561 aaatgctggt aaatccacca ttaatatcat gataactact ataattatag tgattatagt
1621 aatattgtta tcattaattg cagttggact gcttctatac tgcaaggcca gaagcacacc
1681 agtcacacta agtaaggatc aactgagtgg tataaataat attgcattta gtagctgaat
1741 aaaaatagca cttaatcata ttcttacaat ggttcactat ctgaccatag ataacccatc
1801 tatcattgga ttttcttaaa atttgaactt catcacaact ttcatctata aaccatctca
1861 cttacactat ttaagtagat tcctagttta tagttatat
```

FIG. 47B

MELPILKANAITTILAAVTFCFASSQNITEEFYQSTCSAVSKGY
LSALRTGWYTSVITIELSNIKENKCNGTDAKVKLMKQELDKYKNAVTELQLLMQSTPA
ANNRARRELPRFMNYTLNNTKNTNVTLSKKRKRRFLGFLLGVGSAIASGIAVSKVLHL
EGEVNKIKSALLSTNKAVVSLSNGVSVLTSKVLDLKNYIDKQLLPIVNKQSCRISNIE
TVIEFQQKNNRLLEITREFSVNAGVTTPVSTYMLTNSELLSLINDMPITNDQKKLMSN
NVQIVRQQSYSIMSIIKEEVLAYVVQLPLYGVIDTPCWKLHTSPLCTTNTKEGSNICL
TRTDRGWYCDNAGSVSFFPQAETCKVQSNRVFCDTMSSLTLPSEVNLCNVDIFNPKYD
CKIMTSKTDVSSSVITSLGAIVSCYGKTKCTASNKNRGIIKTFSNGCDYVSNKGVDTV
SVGNTLYYVNKQEGKSLYVKGEPIINFYDPLVFPSDEFDASISQVNEKINQSLAFIRK
SDELLHNVNAGKSTTNIMITTIIIVIIVILLSLIAVGLLLYCKARSTPVTLSKDQLSG
INNIAFSN

FIG. 48A

```
   1 taacaatgga gttgccaatc ctcaaagcaa atgcaattac cacaatcctc gctgcagtca
  61 cattttgctt tgcttctagt caaaacatca ctgaagaatt ttatcaatca acatgcagtg
 121 cagttagcaa aggctatctt agtgctctaa gaactggttg gtatactagt gttataacta
 181 tagaattaag taatatcaag gaaaataagt gtaatggaac agatgctaag gtaaaattga
 241 tgaaacaaga attagataaa tataaaaatg ctgtaacaga attgcagttg ctcatgcaaa
 301 gcacaccagc agcaaacaat cgagccagaa gagaactacc aaggtttatg aattatacac
 361 tcaacaatac caaaaaaacc aatgtaacat taagcaagaa aaggaaaaga agatttcttg
 421 gttttttgtt aggtgttgga tctgcaatcg ccagtggcat tgctgtatct aaggtcctgc
 481 acttagaagg agaagtgaac aagatcaaaa gtgctctact atccacaaac aaggccgtag
 541 tcagcttatc aaatggagtt agtgtcttaa ccagcaaagt gttagacctc aaaaactata
 601 tagataaaca attgttacct attgtaaata agcaaagctg cagaatatca aatatagaaa
 661 ctgtgataga gttccaacaa aagaacaaca gactactaga gattaccagg gaatttagtg
 721 ttaatgcagg tgtaactaca cctgtaagca cttacatgtt aactaatagt gaattattgt
 781 cattaatcaa tgatatgcct ataacaaatg atcagaaaaa gttaatgtcc aacaatgttc
 841 aaatagttag acagcaaagt tactctatca tgtccataat aaaagaggaa gtcttagcat
 901 atgtagtaca attaccacta tatggtgtga tagatacacc ttgttggaaa ttacacacat
 961 cccctctatg tacaaccaac acaaaagaag ggtcaaacat ctgtttaaca agaactgaca
1021 gaggatggta ctgtgacaat gcaggatcag tatctttctt cccacaagct gaaacatgta
1081 aagttcaatc gaatcgagta ttttgtgaca caatgaacag tttaacatta ccaagtgaag
1141 taaatctctg caatgttgac atattcaatc caaatatga ttgtaaaatt atgacttcaa
1201 aaacagatgt aagcagctgg gttatcacat ctctaggagc cattgtgtca tgctatggca
1261 aaactaaatg tacagcatcc aataaaaatc gtggaatcat aaagacattt tctaacgggt
1321 gtgattatgt atcaaataaa ggggtggaca ctgtgtctgt aggtaacaca ttatattatg
1381 taaataagca agaaggcaaa agtctctatg taaaggtga accaataata aatttctatg
1441 acccattagt attcccctct gatgaatttg atgcatcaat atctcaagtc aatgagaaga
1501 ttaaccagag tttagcattt attcgtaaat ccgatgaatt attacataat gtaaatgctg
1561 gtaaatcaac cacaaatatc atgataacta ctataattat agtgattata gtaatattgt
1621 tatcattaat tgctgttgga ctgctcctat actgtaaggc cagaagcaca ccagtcacac
1681 taagcaagga tcaactgagt ggtataaata atattgcatt tagtaactga ataaaaatag
1741 cacctaatca tgttcttaca atggtttact atctgctcat agacaaccca tctatcattg
1801 gattttctta aaatctgaac ttcatcgaaa ctcttatcta taaccatct cacttacact
1861 attt
```

FIG. 48B

MDVRICLLLFLISNPSSCIQETYNEESCSTVTRGYKSVLRTGWY
TNVFNLEIGNVENITCNDGPSLIDTELVLTKNALRELKTVSADQVAKESRLSSPRRRR
FVLGAIALGVATAAAVTAGVALAKTIRLEGEVKAIKNALRNTNEAVSTLGNGVRVLAT
AVNDLKEFISKKLTPAINQNKCNIADIKMAISFGQNNRRFLNVVRQFSDSAGITSAVS
LDLMTDDELVRAINRMPTSSGQISLMLNNRAMVRRKGFGILIGVYDGTVVYMVQLPIF
GVIETPCWRVVAAPLCRKEKGNYACILREDQGWYCTNAGSTAYYPNKDDCEVRDDYVF
CDTAAGINVALEVEQCNYNISTSKYPCKVSTGRHPVSMVALTPLGGLVSCYESVSCSI
GSNKVGIIKQLGKGCTHIPNNEADTITIDNTVYQLSKVVGEQRTIKGAPVVNNFNPIL
FPEDQFNVALDQVFESIDRSQDLIDKSNDLLGADAKSKAGIAIAIVVLVILGIFFLLA
VIYYCSRVRKTKPKHDYPATTGHSSMAYVS

FIG. 49A

```
   1 gggacaagta ggatggatgt aagaatctgt ctcctattgt tccttatatc taatcctagt
  61 agctgcatac aagaaacata caatgaagaa tcctgcagta ctgtaactag aggttataag
 121 agtgtgttaa ggacagggtg gtatacgaat gtatttaacc tcgaaatagg gaatgttgag
 181 aacatcactt gcaatgatgg acccagccta attgacactg agttagtact cacaaagaat
 241 gctttgaggg agctcaaaac agtgtcagct gatcaagtgg ctaaggaaag cagactatcc
 301 tcacccagga gacgtagatt tgtactgggt gcaatagcac ttggtgttgc gacagctgct
 361 gccgtaacag ctggtgtagc acttgcaaag acaattagat tagagggaga ggtgaaggca
 421 attaagaatg ccctccggaa cacaaatgag gcagtatcca cattagggaa tggtgtgagg
 481 gtactagcaa ctgcagtcaa tgacctcaaa gaatttataa gtaaaaaatt gactcctgct
 541 attaaccaga acaaatgcaa tatagcagat ataaagatgg caattagttt tggccaaaat
 601 aacagaaggt tcctgaatgt ggtgaggcaa ttctctgata gtgcaggtat cacatcagct
 661 gtgtctcttg atttaatgac agatgatgaa cttgttagag caattaacag aatgccaact
 721 tcatcaggac agattagttt gatgttgaac aatcgtgcca tggttagaag aaggggttt
 781 ggtatattga ttggtgttta tgatggaacg gtcgtttata tggtacaact gcccatattc
 841 ggcgtgattg agacaccttg ttggagggtg gtggcagcac cactctgtag aaaagagaaa
 901 ggcaattatg cttgtatact gagagaagat caagggtggt actgtacaaa tgctggctct
 961 acagcttatt atcctaataa agatgattgt gaggtaaggg atgattatgt attttgtgac
1021 acagcagctg cattaatgt ggccctagaa gttaacagt gcaactataa catatcgact
1081 tctaaatacc catgcaaagt cagcacaggt agacaccctg tcagtatggt agccttaacc
1141 cccctagggg gtctagtgtc ttgttatgag agtgtaagtt gctccatagg tagcaataaa
1201 gtagggataa taaaacagct aggcaaaggg tgcacccaca ttcccaacaa cgaagctgac
1261 acgataacca ttgataacac tgtgtaccaa tgagcaaggt tgtaggcga acagaggacc
1321 ataaaggag ctccagttgt gaacaatttt aacccaatat tattcctga ggatcagttc
1381 aatgttgcac ttgaccaagt atttgagagt atagatagat ctcaggactt aatagataag
1441 tctaacgact tgctaggtgc agatgccaag agcaaggctg gaattgctat agcaatagta
1501 gtgctagtca ttctaggaat cttctttta cttgcagtga tatattactg ttccagagtc
1561 cggaagacca aaccaaagca tgattacccg gccacgacag gtcatagcag catggcttat
1621 gtcagttaag ttattt
```

FIG. 49B

METYVNKLHEGSTYTAAVQYNVLEKDDDPASLTIWVPMFQSSIS
ADLLIKELINVNILVRQISTLKGPSLKIMINSRSAVLAQMPNKFTISANVSLDERSKL
AYDITTPCEIKACSLTCLKVKNMLTTVKDLTMKTFNPTHEIIALCEFENIMTSKKVVI
PTFLRSINVKAKDLDSLENIATTEFKNAITNAKIIPYAGLVLVITVTDNKGAFKYIKP
QSQFIVDLGAYLEKESIYYVTTNWKHTATRFSIKPIED

FIG. 50A

```
  1 ggggcaaata tggagacata cgtgaacaaa ctccatgaag ggtcaacata cacagctgct
 61 gtccaataca atgttctaga aaaggatgat gatcctgcat ctctcacgat atgggttcct
121 atgtttcaat catccatttc tgctgactta ctcataaagg agttaatcaa tgtgaacata
181 ttagtacgac aaatttctac tctgaaaggc ccatcattaa aaattatgat aaactctaga
241 agtgctgtac tagctcaaat gcccaacaag tttactataa gtgcaaatgt gtcattggat
301 gaacggagca agttggcata tgacataacc accccttgtg agatcaaagc ttgcagtttg
361 acatgcttaa aagtaaaaaa tatgctcact actgtaaaag atcttactat gaaaacattc
421 aatcccactc atgaaatcat tgcactgtgt gaatttgaaa atattatgac gtctaagaaa
481 gttgtaatac caactttttt aaggtctatt aatgtgaagg caaaggattt agattcactg
541 gaaaacatag ctacaacaga gtttaaaaat gccatcacta atgctaaaat tataccttac
601 gctgggttag tgttagtcat taccgtaact gacaacaaag gagcatttaa gtatatcaag
661 ccacaaagcc aatttatagt tgatcttggt gcatatcttg aaaaagagag catatattat
721 gtaactacaa attggaaaca cacagccact agattctcca tcaaacctat agaagattaa
781 atcctaaaca aattatcttg ccaaaataga acactctatt aagaacctac aaaacaccat
841 tgaaatcaaa tcctattgat actccattga acatcactgt cacacattcc caatctggtc
901 aattcacttg atcatctatt ctgttaatta tacctctatt agataaat
```

FIG. 50B

MSRRNPCKYEIRGHCLNGKKCHFSHNYFEWPPHALLVRQNFMLN
KILKSMDRSNDTLSEISGAAELDRTEEYALGVIGVLESYLGSVNNITKQSACVAMSKL
LGEINSDDIKGLRNKELPTSPKIRIYNTVISYIDSNKRNPKQTIHLLKRLPADVLKKT
IKNTIDIHNEINVNNPSDIGVNEQNE

FIG. 51A

```
  1 ggggcaaata tgtcacgaag aaatccctgc aaatatgaga tcaggggaca ttgcttaaat
 61 ggcaaaaaat gccatttcag ccataattac tttgaatggc ctccacatgc tttattagtg
121 aggcaaaatt ttatgttaaa caagatatta aagtctatgg ataggagcaa tgatactctg
181 tcagagataa gtggagctgc agaattagat agaacagagg aatatgcatt aggtgtgata
241 ggagttttag aaagttactt gggctctgtt aataacataa caaaacaatc agcttgtgtt
301 gctatgagta aattattagg tgagattaat agtgatgaca tcaaggatt aagaaacaaa
361 gaattgccaa cttcacctaa gataagaata tataacacag ttatatcata tattgatagc
421 aacaagagaa acccaaaaca aactatacat ttacttaaaa gattgcctgc agatgtgctt
481 aagaagacca tcaagaatac aatagatatt cacaatgaaa taaatgttaa taatccaagt
541 gacataggtg ttaatgaaca aaatgaataa ttccaatatc attattttcc cagagaaata
601 tccttgtagt atatcttctt tgttaatcag agatgagaat aatgttattg tattaaatca
661 tcagaatatt tttgactgct cacagtctca acatccatgt gatatgtatc ctcaaaatca
721 tatacttgac tatacctatt ggacatcaca ggaattgatt gacgatgtac taaagattct
781 tcacctttct agcatcccca taaataggta tgtggtctat gtcttagtgc tgtagtatgt
841 aaatcattta actttcaatc attatctata tatttctcct tgtagccgga aatacaccag
901 aggacaaaat ggactcactc attcatgaaa actcaaccaa tgtatactta acagatagtt
961 attt
```

FIG. 51B

MALSKVKLNDTFNKDQLLSTSKYTIQRSTGDNIDIPNYDVQKHL
NKLCGMLLITEDANHKFTGLIGMLYAMSRLGREDTLKILKDAGYQVKANGVDVITHRQ
DVNGKEMKFEVLTLVSLTSEVQVNIEVESRKSYKKMLKEMGEVAPEYRHDSPDCGMIV
LCIAALVIAKLAAGDRSGLTAVIRRANNVLKNEIERYKGLIPKDVANSFYEVFEKYPH
YIDVFVHFGIAQSSTRGGSRVEGIFAGLFMNAYGAGQVMLRWGVLAKSVKNIMLGHAS
VQAEMEQVVEVYEYAQKLGGEAGFYHILNNPKASLLSLTQFPNFSSVVLGNAAGLGIM
GEYRGTPRNQDLYDAAKAYAEQLKENGVINYSVLDLTTEELEAIKNQLNPKDNDVEL

FIG. 52A

```
   1 ggggcaaata caaaaatggc tctcagcaag gttaaactga atgacacctt caacaaagat
  61 caattgctat caactagcaa atataccatc caacgtagca ctggagataa tattgacata
 121 cctaattatg atgtacaaaa gcatctcaat aaattgtgtg gtatgctgct aataacagaa
 181 gatgctaatc acaaatttac aggattaata ggtatgttat atgccatgtc tcgattggga
 241 agggaagata ccctcaaaat actcaaggat gcaggttacc aagtaaaggc caatggagtt
 301 gatgtaatta cacatcgaca agatgtaaat ggaaaagaaa tgaaatttga agtgctaaca
 361 ctagtcagct aacatcaga agttcaagtt aacattgagg tagaatcaag gaaatcttac
 421 aaaaagatgc taaaagagat gggagaggta gctccagaat acagacatga ttctcctgat
 481 tgtggtatga tagtgctatg tattgctgct ttggttatag caaaattagc agcaggggat
 541 agatcaggcc tcaccgcagt catcagaaga gccaacaatg tgcttaagaa tgaaatagag
 601 cgatacaagg gacttatacc aaaggatgta gccaacagct tctatgaagt atttgaaaag
 661 tatcctcatt atatagacgt atttgtacat tttggaattg ctcagtcctc aacaagagga
 721 ggtagtaggg tagaggggat ctttgcaggg ttattcatga atgcgtatgg agcaggtcaa
 781 gtaatgttaa gatggggtgt attagccaaa tcagtcaaga atatcatgct tggtcatgcc
 841 agtgtgcaag ctgaaatgga acaagttgta gaagtctatg aatatgcaca aaaattagga
 901 ggagaagcag gtttctacca catattaaac aacccaaaag catcattatt gtcccttaca
 961 cagtttccta acttctccag tgtagtccta ggtaatgctg ctggtttggg aataatgggt
1021 gagtatagag gtacacctag gaatcaggat ttatatgatg ctgccaaagc atatgcagaa
1081 caactgaaag agaatggagt catcaattac agtgtattag atctaactac agaggaatta
1141 gaggcaatca agaaccagct aaatcccaag gataatgatg tggaactgtg agttaat
```

FIG. 52B

MALSKVKLNDTLNKDQLLSTSKYTIQRSTGDSIDTPNYDVQKHI
NKLCGMLLITEDANHKFTGLIGMLYAMSRLGREDTLKILKDAGYHVKANGVDVITHRQ
DINGKEMKFEVLTLASLTTEIQINIEIESRKSYKKMLKEMGEVAPEYRHDSPDCGMII
LCIAALVITKLAAGDRSGLTAVIRRANNVLKNEMKRYKGLIPKDIANSFYEVFEKHPH
FIDVFVHFGIAQSSTRGGSRVEGIFAGLFMNAYGAGQVMLRWGVLAKSVKNIMLGHAS
VQAEMEQVVEVYEYAQKLGGEAGFYHILNNPKASLLSLTQFPHFSSVVLGNAAGLGIM
GEYRGTPRNQDLYDAAKAYAEQLKENGVINYSVLDLTAEELTLKTTKKDPKPQTTKSK
EVPTTKPTEEPTINTTKTNIITTLLTSNTTGNPELTSQMETPHSTSSEGNPSPSQVST
TSEYPSQPSSPPNTPRQ

FIG. 53A

```
   1 caaatacaaa gatggctctt agcaaagtca agttgaatga tacactcaac aaagatcaac
  61 ttctgtcatc cagcaaatac accatccaac ggagcacagg atatagtatt gatactccta
 121 attatgatgt gcagaaacac atcaataagt tatgtggcat gttattaatc acagaagatg
 181 ctaatcataa attcactggg ttaataggta tgttatatgc gatgtctagg ttaggaagag
 241 aagacaccat aaaaatactc agagatgcgg gatatcatgt aaaagcaaat ggagtagatg
 301 taacaacaca tcgtcaagac attaatggaa aagaaatgaa atttgaagtg ttaacattgg
 361 caagcttaac aactgaaatt caaatcaaca ttgagataga atctagaaaa tcctacaaaa
 421 aaatgctaaa agaaatggga gaggtagctc cagaatacag gcatgactct cctgattgtg
 481 ggatgataat attatgtata gcagcattag taataactaa attagcagca ggggacagat
 541 ctggtcttac agccgtgatt aggagagcta ataatgtcct aaaaaatgaa atgaaacgtt
 601 acaaaggctt actacccaag gacatagcca acagcttcta tgaagtgttt gaaaaacatc
 661 cccactttat agatgttttt gttcattttg gtatagcaca atcttctacc agaggtggca
 721 gtagagttga agggattttt gcaggattgt ttatgaatgc ctatggtgca gggcaagtga
 781 tgttacggtg gggagtctta gcaaaatcag ttaaaaatat tatgttagga catgctagtg
 841 tgcaagcaga aatggaacaa gttgttgagg tttatgaata tgcccaaaaa ttgggtggtg
 901 aagcaggatt ctaccatata ttgaacaacc caaaagcatc attattatct ttgactcaat
 961 ttcctcactt ctccagtgta gtattaggca atgctgctgg cctaggcata atgggagagt
1021 acagaggtac accgaggaat caagatctat atgatgcagc aaaggcatat gctgaacaac
1081 tcaaagaaaa tggtgtgatt aactacagtg tactagactt gacagcagaa gaactaaccc
1141 tcaagacaac caaaaaagat cccaaacctc aaaccactaa atcaaaggaa gtacccacca
1201 ccaagcccac agaagagcca accatcaaca ccaccaaaac aaacatcata actacactac
1261 tcacctccaa caccacagga aatccagaac tcacaagtca aatggaaacc ttccactcaa
1321 cttcctccga aggcaatcca agcccttctc aagtctctac aacatccgag tacccatcac
1381 aaccttcatc tccacccaac acaccacgcc agtagttact t
```

FIG. 53B

MALSKVKLNDTFNKDQLLSTSKYTIQRSTGDNIDTPNYDVQKHL
NKLCGMLLITEDANHKFTGLIGMLYAMSRLGREDTLKILKDAGYQVRANGVDVITHRQ
DVNGKEMKFEVLTLVSLTSEVQGNIEIESRKSYKKMLKEMGEVAPEYRHDSPDCGMIV
LCVAALVITKLAAGDRSGLTAVIRRANNVLRNEMKRYKGLIPKDIANSFYEVFEKYPH
FIDVFVHFGIAQSSTRGGSRVEGIFAGLFMNAYGAGQVMLRWGVLAKSVKNIMLGHAS
VQAEMEQVVEVYEYAQKLGGEAGFYHILNNPKASLLSLTQFPHFSSVVLGNAAGLGIM
GEYRGTPRNQDLYDAAKAYAEQLKENGVINYSVLDLTAEELEAIKNQLNPKDNDVEL

FIG. 54A

```
   1 ngggcaaata caaaaatggc tcttagcaag gtcaaactaa atgacacttt caacaaggac
  61 caactgttgt caaccagcaa atatactatt caacgtagta caggtgacaa cattgatata
 121 cccaattacg atgtgcaaaa acatctcaat aagttgtgtg gtatgctatt aataacagaa
 181 gatgccaatc ataaatttac aggactgata ggtatgttat atgctatgtc ccgattgggg
 241 agagaagata cccttaaaat actcaaagat gcaggctacc aagtgagggc aatggggtt
 301 gatgtgataa cacatcgaca ggatgtgaat ggaaaagaaa tgaaatttga agtgctaaca
 361 ttagtcagct taacatcaga agttcaaggt aatatagaaa tagagtcaag gaagtcttac
 421 aaaaagatgc taaaagagat gggagaggta gctccagaat acagacatga ctttcctgat
 481 tgtggtatga tagtgctatg tgttgctgct tggttataaa caaaattagc agcaggtgat
 541 aggtcaggcc tcactgcagt cattaggaga gccaacaatg tactaaggaa tgaaatgaaa
 601 cgatacaaag gactcatccc gaaagatata gccaacagct ctatgaagt atttgaaaag
 661 taccctcatt acatagatgt attcgtacat tttggcattg ctcaatcctc aactagagga
 721 ggtagtaggg tagaaggaat ctttgcaggg ttattcatga atgcatatgg agcaggtcaa
 781 gtgatgttaa gatgggtgt gctagccaaa tcagtcaaga acattatgct tggtcatgcc
 841 agcgtacaag cagaaatgga acaggttgta gaagtctatg aatatgcaca aaagttaggt
 901 ggagaagctg gttttatca catactgaac aatcctaaag catcattgtt atccttgaca
 961 caattcccca acttctctag tgtagtccta ggcaatgctg caggactagg tataatgggt
1021 gagtatagag gtacaccaag aaaccaagac ttgtatgatg ctgccaaagc atatgcagaa
1081 caactaaaag agaatggggt catcaattac agtgtgttgg atctgactac agaggaatta
1141 gaggcaatca gaaccaatt gaatcccaaa gataatgatg tggaattgtg agttaat
```

FIG. 54B

MLSLFDTFNARRQENITKSAGGAIIPGQKNTVSIFALGPTITDD
NEKMTLALLFLSHSLDNEKQHAQRAGFLVSLLSMAYANPELYLTTNGSNADVKYVIYM
IEKDLKRQKYGGFVVKTREMIYEKTTEWIFGSDLDYDQETMLQNGRNNSTIEDLVHTF
GYPSCLGALIIQIWIVLVKAITSISGLRKGFFTRLEAFRQDGTVQAGLVLSGDTVDQI
GSIMRSQQSLVTLMVETLITMNTSRNDLTTIEKNIQIVGNYIRDAGLASFFNTIRYGI
ETRMAALTLSTLRPDINRLKALMELYLSKGPRAPFICILRDPIHGEFAPGNYPAIWSY
AMGVAVVQNRAMQQYVTGRSYLDIDMFQLGQAVARDAEAQMSSTLEDELGVTHEAKES
LKRHIRNINSSETSFHKPTGGSAIEMAIDEEPEQFEHRADQEQDGEPQSSIIQYAWAE
GNRSDDRTEQATESDNIKTEQQNIRDRLNKRLNDKKKQGSQPSTNPTNRTNQDEIDDL
FNAFGSN

FIG. 55A

```
   1 gaggattaaa gacattgact agaaggtcaa gaaaagggaa ctctataatt tcaaaaatgt
  61 tgagcctatt tgatacattt aatgcacgta ggcaagaaaa cataacaaaa tcagctggtg
 121 gagctatcat tcctggacag aaaaatactg tctccatatt tgcccttgga ccgacaataa
 181 ctgatgacaa tgagaaaatg acattagctc ttctatttct atctcattca ctagataatg
 241 agaaacaaca tgcacaaagg gcagggttct tggtgtcttt attgtcaatg gcttatgcca
 301 atccagagct ttacctgaca caaatggaa gtaatgcaga tgttaaatat gtcatatata
 361 tgattgagaa agatctaaaa cggcaaaagt atggaggatt tgtggttaag acgagagaga
 421 tgatatatga aaagacaact gagtggatat ttggaagtga cctggattat gaccagaaa
 481 ctatgctgca aacggcaga aacaattcaa cgattgaaga tcttgttcac acatttgggt
 541 atccatcatg tttaggagct cttataatac agatctggat agttttggtc aaagccatca
 601 ctagcatctc agggttaaga aaaggctttt tcactcgatt agaggctttc agacaagatg
 661 gaacagtgca agcagggctg gtattgagcg gtgacacagt ggatcagatt gggtcaatca
 721 tgcggtctca acagagcttg gtaactctta tggttgagac attaataaca atgaatacta
 781 gcagaaatga cctcacaacc atagaaaaga atatacaaat tgttggtaac tacataagag
 841 atgcaggtct tgcttcattc ttcaatacaa tcaggtatgg aattgagact agaatggcag
 901 ctttgactct atctactctc agaccagata tcaatagatt aaaagctctg atggaattgt
 961 atttatcaaa gggaccacgc gctcctttta tctgtatcct cagagatcct atacatggtg
1021 agttcgcacc aggcaactat cctgccatat ggagttatgc aatgggggtg gcagttgtac
1081 aaaacagagc catgcaacag tatgtgacgg gaagatcata tctagatatt gatatgttcc
1141 agctgggaca agcagtagca cgtgatgctg aagctcagat gagctcaaca ctggaagatg
1201 aacttggagt gacacacgaa gccaagaaa gcttgaaaag acatataagg aacataaaca
1261 gttcagagac atctttccac aaaccaacag gcggatcagc catagagatg caatagatg
1321 aagagccaga acaatttgaa cacagagcag atcaagaaca agatggagaa cctcaatcat
1381 ctataatcca atatgcttgg gcagaaggaa acagaagtga tgatcggacc gagcaagcta
1441 cagaatccga caatatcaag actgaacaac aaaacatcag agacagacta aacaagagac
1501 tcaacgacaa gaagaaacaa ggcagtcaac catccaccaa tcccacaaac agaacgaacc
1561 aggacgaaat agacgatctg ttcaatgcat ttggaagcaa ctaactgagt caacattttg
1621 atctaaatca ataataaata ag
```

FIG. 55B

MPTSILLIITTMIMASFCQIDITKLQHVGVLVNSSKGMKISQNF
ETRYLILSLIPKIEDSNSCGDQQIKQYKRLLDRLIIPLYDGLRLQKDVIVSNQESNEN
TDPRTKRFFGGVIGTIALGVATSAQITAAVALVEAKQARSDIEKLKEAIRDTNKAVQS
VQSSIGNLIVAIKSVQDYVNKEIVPSIARLGCEAAGLQLGIALTQHYSELTNIFGDNI
GSLQEKGIKLQGIASLYRTNITEIFTTSTVDKYDIYDLLFTESIKVRVIDVDLNDYSI
ALQVRLPLLTRLLNTQIYRVDSISYNIQNREWYIPLPSHIMTKGAFLGGADVKECIEA
FSSYICPSDPGFVLNHEMESCLSGNISQCPRTVVKSDIVPRYAFVNGGVVANCITTTC
TCNGIGNRINQPPDQGVKIITHKECNTIGINGMLFNTNKEGTLAFYTPNDITLNNSVA
LDPIDISIELNKAKSDLEESKEWIRRSNQKLDSIGNWHQSSTTIIIVLIMIIILFIIN
VTIIIIAVKYYRIQKRNRVDQNDKPYVLTNK

FIG. 56A

```
   1 aggacaaaag aagtcaatac caacaactat tagcagccac actcgctgga acaagaaaga
  61 agggataaaa aaagtttaac agaagaaaca aaaacaaaaa gcacagaaca ccagaacaac
 121 aagatcaaaa cacccaaccc actcaaaacg aaaatctcaa aagagattgg caacacaaca
 181 aacactgaac atcatgccaa cctcaatact gctaattatt acaaccatga ttatggcatc
 241 tttctgccaa atagatatca caaaactaca gcatgtaggt gtattggtta acagttccaa
 301 agggatgaag atatcacaaa actttgaaac aagatatcta attttgagcc tcataccaaa
 361 aatagaagat tctaactctt gtggtgacca acagatcaag caatacaaga ggttattgga
 421 tagactgatc attccttta t atgatggatt aagattacag aaggatgtga tagtgtccaa
 481 tcaagaatcc aatgaaaaca ctgacccag aacaaaacga ttctttggag gggtaattgg
 541 aactattgct ctgggagtgg caacctcagc acaaattaca gcggcagttg ctctggttga
 601 agccaagcag gcaagatcag acattgaaaa actcaaggaa gcaatcaggg acacaaacaa
 661 agcagtgcag tcagtccaga gctccatagg aaatttgata gtagcaatta atcggtcca
 721 ggattatgtc aacaaagaaa tcgtgccatc aattgcgaga ttaggttgtg aagcagcagg
 781 acttcagtta ggaattgcat taacacagca ttactcagaa ttaacaaaca tattcggtga
 841 taacatagga tcgttacaag aaaaagggat aaaattacaa ggtatagcat cattataccg
 901 cacaaatatc acagagatat tcacaacatc aacagttgat aaatatgata tttatgatct
 961 attatttaca gaatcaataa aggtgagagt tatagatgtt gacttgaatg attactcgat
1021 cgccctccaa gtcagactcc ctttattaac tagactgctg aacacccaga tttacagagt
1081 agattccata tcatataaca tccaaaacag agaatggtat atccctcttc ccagccacat
1141 catgacaaaa ggggcatttc taggtggagc agatgtcaaa gaatgtatag aagcattcag
1201 cagttatata tgcccttctg atccaggatt tgtactaaac catgaaatgg agagctgttt
1261 atcaggaaac atatcccaat gtccaagaac cgtggttaaa tcagacattg ttccaagata
1321 tgcatttgtc aatggaggag tggttgcaaa ttgtataaca accacatgta catgcaacgg
1381 tatcggtaat agaatcaatc aaccacctga tcaaggagta aaaattataa cacataaaga
1441 atgtaataca ataggtatca acggaatgct gttcaataca aataaagaag gaactcttgc
1501 attttacaca ccaaatgata acattaaa caattctgtt gcacttgatc caattgacat
1561 atcaatcgag ctcaataagg ccaaatcaga tctagaagag tcaaaagaat ggataagaag
1621 gtcaaatcaa aaactagatt ccattggaaa ttggcatcaa tctagcacca caatcataat
1681 tgtttttgata atgataatta tattgtttat aattaatgta acgataatta taattgcagt
1741 taagtattac agaattcaaa agagaaatcg agtggatcaa aatgataaac catatgtatt
1801 aacaaacaaa tgacagatct atagatcatt agatattaaa attat
```

FIG. 56B

MPISILLIITTMIMASFCQIDITKLHHVGVLVNSPKGMKISQNF
ETRYLILSLIPKIEDSNSCGDQQIRQYKKLLDRLIIPLYDGLRLQKDVIVTNQESNEN
TDPRTKRFFGGVIGTIALGVATSAQITAAVALVEAKQARSDIEKLKEAIRDTNKAVQS
VQSSIGNLIVAIKSVQDYVNKEIVPSIARLGCEAAGLQLGIALTQHYSELTNIFGDNI
GSLQEKGIKLQGIASLYRTNITEIFTTSTVDKYDIYDLLFTESIKVRVIDVDLNDYSI
TLQVRLPLLTRLLNTQIYKVDSISYNIQNREWYIPLPSHIMTKGAFLGGADVKECIEA
FSSYICPSDPGFVLNHEIESCLSGNISQCPRTTVTSDIVPRYAFVNGGVVANCITTTC
TCNGIGNRINQPPDQGIKIITHKECSTIGINGMLFNTNKEGTLAFYTPNDITLNNSVA
LDPIDISIELNKAKSDLEESKEWIRRSNQKLDSIGNWHQSSTTIIIILIMIIILFIIN
VTIITIAIKYYRIQKRNRVDQNDEPYVLTNK

FIG. 57A

```
   1 aggacaaaag aggtcaatac caacaactat tagcagtcat actcacaaga ataagaaaga
  61 agggatttaa aaagttaaat aggagaaata aaaacaaaaa gtacagaaca ccagagcgat
 121 aaaatcaaaa catctaactc actcaaaaca aaaattccaa aagagaccgg taatacaaca
 181 agcactgagc acaatgccaa tttcaatact gctgattatt acaaccatga tcatggcatc
 241 cttctgtcaa atagatatca caaaactaca tcatgtaggt gtattggtca atagtcccaa
 301 agggatgaag atatcacaaa actttgaaac aagatatctg attttgagcc tcataccaaa
 361 aatagaagac tctaactctt gtggtgacca acagatcagg caatacaaga agctattgga
 421 tagactgatc atcccttat atgatggatt aagattacag aaagatgtga tagtaactaa
 481 tcaagaatcc aatgaaaaca ctgatcctag aacaaaacga ttctttggag gggtaattgg
 541 aactattgct ctgggagtag caacctcagc acaaattaca gcagcagttg ctttggtcga
 601 agccaagcag gcaagatcag acatcgaaaa acttaaagaa gcaattaggg acacaaataa
 661 agcagtgcag tcagttcaga gctccatagg aaatctaata gtagcaatta atcagtcca
 721 ggattatgtc aacaaagaaa tcgtgccatc gattgcaagg ctaggttgtg aagcagcagg
 781 acttcaatta ggaattgcat taacacagca ttactcagaa ttaacaaaca tatttggtga
 841 taacatagga tcgttacaag aaaaaggaat aaaattacaa ggtatagcat cattataccg
 901 cacaaacatc acagaaatat tcacaacatc aacagttgat aaatatgata tttatgatct
 961 attatttaca gaatcaataa aggtgagagt tatagatgtt gacttgaatg attactcaat
1021 caccctccaa gtcagactcc ctttattaac tagactgctg aacactcaga tctacaaagt
1081 agattccata tcatacaaca tccaaaacag gaatggtat atccctcttc ccagccacat
1141 catgacgaaa ggggcatttc taggtggagc agatgtcaaa gaatgcatag aagcattcag
1201 cagctatata tgcccttctg atccaggatt tgtactaaac catgaaatag agagctgctt
1261 atcaggaaac atatctcaat gtccaagaac cacagtcaca tcagacattg ttccaagata
1321 tgcatttgtc aatggaggag tggttgcaaa ctgtataaca accacttgta catgcaacgg
1381 aatcggtaat agaatcaatc aaccacctga tcaaggaata aaaattataa cacataaaga
1441 atgtagtaca ataggtatca acggaatgct gttcaataca aataaagaag gaactcttgc
1501 attctacaca ccaaatgata taacactaaa caattctgtt gcacttgatc caattgacat
1561 atcaatcgag ctcaacaagg ccaaatcaga tctaaaagaa tcaaaagaat ggataagaag
1621 gtcaaatcaa aaactagatt ccattggaaa ttggcatcaa tctagcacta caatcataat
1681 tattttgata atgatcatta tattttat aattaatgta acgataatta caattgcaat
1741 taagtattac agaattcaaa agagaaatcg agtggatcaa aatgatgagc catatgtact
1801 aacaaacaaa taacatatct acagatcatt agatattaaa attataaaaa a
```

FIG. 57B

MSITNSAIYTFPESSFSENGHIEPLPLKVNEQRKAVPHIRVAKI
GNPPKHGSRYLDVFLLGFFEMERIKDKYGSVNDLDNDPGYKVCGSGSLPIGLVKYTGN
IQELLQAATKLDIEVRRTVKAKEMIVYTVQNIKPELYPWSSRLRKGMLFDANKVALAP
QCLPLDRSIKFRVIFVNCTAIGSITLFKIPKSMASLSLPSTISINLQVHIKTGVQTDS
KGIVQILDEKGEKSLNFMVHLGLIKRKVGRMYSVEYCKQKIEKMRLIFSLGSVGGISL
HVNATGSISKTLASQLVFKREICYPLMDLNPHLNLVIWASSVEITRVDAIFQPSLPGE
FRYYPNIIAKGVGKIKQWN

FIG. 58A

```
   1 aggattaaag aataaattaa tccttgtcca aaatgagtat aactaactct gcaatataca
  61 cattcccgga gtcatcattc tctgagaatg gtcatataga accattacca ctcaaagtca
 121 atgaacagag aaaagcagta cctcacatta gagttgccaa aatcggaaat ccaccaaaac
 181 atggatcccg gtatttggat gtcttcttac tcggcttctt cgagatggaa cgaatcaaag
 241 acaaatacgg gagtgtgaat gatcttgaca atgacccggg ttacaaagtt tgtggctctg
 301 gatcattacc aatcggatta gttaaataca ctgggaatat ccaggaatta ttacaggcag
 361 caactaaact ggacatagaa gtgagaagaa cagtcaaagc gaaagaaatg attgtttata
 421 cggtacaaaa tataaaacca gaactgtacc catggtccag tagactaaga aaaggaatgt
 481 tgttcgatgc caacaaagtt gctcttgctc ctcaatgtct tccactagat aggagcataa
 541 aattcagagt aatcttcgtt aattgtacgg caattggatc aataaccttg tttaaaattc
 601 ccaagtcaat ggcatcacta tctctaccca gcacaatatc aatcaatctg caggtacaca
 661 tcaaaacagg ggttcagact gattctaaag ggatagttca aattttggat gagaagggtg
 721 aaaaatcact gaatttcatg gtccatctc gattgatcaa aagaaagta ggcagaatgt
 781 actctgtcga gtactgtaaa cagaaaatcg agaaatgag attgatattt tctttgggat
 841 cagttggagg aatcagtctt catgtcaatg caactggatc tatatcaaaa acactagcaa
 901 gtcagctggt attcaaaagg gagatttgtt atcccttaat ggatctaaat ccacatctca
 961 atctagttat ctgggcttca tcagtagaga ttacaagagt ggatgcaatt ttccaacctt
1021 ctttacctgg cgagttcaga tactatccta acattattgc aaaaggagtt gggaaaatca
1081 aacaatggaa ctagtaatct ctattttgat ctggatatat ctattaagcc aaagcaaata
1141 agagataatc
```

FIG. 58B

```
MEYWKHTNHGKDAGNEPETSTATNGNKLTNKITYILWTITLMLL
SIIFIIVLINSIKSEKARESLLQDINNEFMEVTEKIQVASDNTNDLIQSGVNTRLLTI
QSHVQNYIPISLTQQISDLRKFISEITIRNDNQEVPPQRITHDVGIKPLNPDDFWRCT
SGLPSLMKTPKIRLMPGPGLLAMPTTVDGCVRTPSLVINDLIYAYTSNLITRGCQDIG
KSYQVLQIGIITVNSDLVPDLNPRISHTFNINDNRKSCSLALLNTDVYQLCSTPKVDE
RSDYASSGIEDIVLDIVNYDSSISTTRFKNNNISFDQPYAALYPSVGPGIYYKGKIIF
LGYGGLEHPINENAICNTTGCPGKTQRDCNQASHSPWFSDRRMVNSIIVVDKGLNSVP
KLKVWTISMRQNYWGSEGRLLLLGNKIYIYTRSTSWHSKLQLGIIDITDYSDIRIKWT
WHNVLSRPGNNECPWGHSCPDGCITGVYTDAYPLNPTGSIVSSVILDSQKSRVSPVIT
YSTATERVNELAIRNKTLSAGYTATSCITHYNKGYCFHIVEINHKSLITFQPMLFKTE
IPKSCS
```

FIG. 59A

```
   1 atggaatact ggaagcacac caatcacgga aaggatgctg gtaatgagcc ggagacatcc
  61 acagccacta atggcaacaa gctcaccaac aagataacat atatattatg gacgataacc
 121 ctgatgttat tatcaataat cttcatcata gtgctaatta attccatcaa aagtgaaaag
 181 gcccgcgaat cattgctaca agacataaat aatgagttta tggaagttac agaaaagatc
 241 caagtggcat cggataatac taatgatcta atacaatcag gagtaaatac aaggcttctt
 301 acaattcaga gtcatgtcca gaattatata ccaatatcat tgacacaaca aatatcggat
 361 cttaggaaat tcattagtga aattacaatt agaaatgata tcaagaagt gccaccacaa
 421 agaataacac atgatgtggg tataaaacct taaatccag atgatttctg gagatgcaca
 481 tctggtcttc catctttgat gaaaactcca aaaataagat tattgccggg gccaggatta
 541 ttagctatgc caacgactgt tgatggctgt gtcagaactc cgtccttagt gataaatgat
 601 ctgatttatg cttacacctc aaatctaatc actcgaggtt gccaagatat agggaaatca
 661 tatcaagtgt tacagatagg gataataact gtaaactcag acttggtacc tgacttaaat
 721 cccaggatct ctcataccett caacataaat gacaatagaa agtcatgttc tctagcactc
 781 ctaaacacag atgtatatca actgtgttca actcccaaag ttgatgaaag atcagattat
 841 gcatcatcag gcatagaaga tattgtactt gatattgtca attatgatag ctcaatctca
 901 acaacaagat taagaataa taatataagt tttgaccaac catatgcggc attatacccca
 961 tctgttggac cagggatata ctacaaaggc aaaataatat ttcttggta tggaggtctt
1021 gaacatccaa taaatgagaa tgcaatctgc aacacaactg ggtgtcctgg gaaaacacag
1081 agagactgca atcaagcatc tcatagtcca tggttttcag atagaaggat ggtcaactct
1141 atcattgttg ttgacaaggg tttaaactca gttccaaaat tgaaggtatg gacgatatcg
1201 atgagacaaa attactgggg gtcagaagga agattacttc tactaggtaa caagatctac
1261 atatacacaa gatctacaag ttggcacagc aagttacaat aggaataat tgacattact
1321 gactacagtg atataaggat aaaatggaca tggcataatg tgctatcaag accaggaaac
1381 aatgaatgtc catggggaca ttcatgtccg gatggatgta acaggagt atatactgat
1441 gcatatccac tcaatcccac aggaagcatt gtatcatctg tcatattaga ctcacaaaaa
1501 tcgagagtca gcccagtcat aacttactca acagcaaccg aaagggtaaa cgagctggcc
1561 atccgaaaca aacactctc agctgggtat acagcaacaa gctgcattac acactataac
1621 aaaggatatt gttttcatat agtagaaata aatcataaaa gcttaatcac atttcaacct
1681 atgttgttca aaacagagat tccaaaaagc tgcagttaa
```

FIG. 59B

MEYWKHTNHGKDVGNELETSTATHGNKLTNKITYILWTITLVLL
SIVFIIVLINSIKSEKARESLLQDINNEFMEVTEKIQVASDNTNDLIQSGVNTRLLTI
QSHVQNYIPISLTQQISDLRKFISEITIRNDNQEVPPQRITHDVGIKPLNPDDFWRCT
SGLPSLMKTPKIRLMPGPGLLAMPTTVDGCVRTPSLVINDLIYAYTSNLITRGCQDIG
KSYQVLQIGIITVNSDLVPDLNPRISHTFNINDNRKSCSLALLNTDVYQLCSTPKVDE
RSDYASSGIEDIVLDIVNYDGSISTTRFKNNNISFDQPYAALYPSVGPGIYYKGKIIF
LGYGGLEHPINENAICNTTECPGKTQRDCNQASHSPWFSDRRMVNSIIVVDKGLNSVP
KLKVWSISMRQNYWGSEGRLLLLGNKIYIYTRSTSWHSKLQLGIIDITDYSDIRIKWT
WHNVLSRPGNNECPWGHSCPDGCITGVYTDAYPLNPTGSIVSSVILDSQKSRVNPVIT
YSTATERVNELAIRMETLSAGYTTTSCITHYNKGYCFHIVEINHKSLNTFQPMLFKTE
IPKSCS

FIG. 60A

```
   1 atggaatact ggaagcacac caaccacgga aaggatgttg gtaatgagct ggaaacatcc
  61 acagccacta atggcaacaa gctcaccaac aagataacat atatattatg gacgataacc
 121 ctggtgttat tatcaatagt cttcatcata gtgctaacta attccatcaa aagtgaaaag
 181 gcccgcgaat cattgctaca agacataaat aatgagttta tggaagttac agaaaagatc
 241 caagtggcat ctgataatac taatgatcta atacagtcag gagtgaatac aaggcttctt
 301 acaattcaga gtcatgtcca gaattatata ccaatatcat tgacacaaca aatatcggat
 361 cttaggaaat tcattagtga aattacaatt agaaatgata tcaagaagt gccaccacaa
 421 agaataacac atgatgtagg tataaaacct ttaaatccag atgatttctg gagatgcaca
 481 tctggtcttc catctttaat gaaaactcca aaaataagat taatgccggg cccaggatta
 541 ttagctatgc caacgactgt tgatggctgt gtcagaaccc cgtccttagt gataaatgat
 601 ctgatttatg cttacacctc aaatctaatt actcgaggtt gccaggatat agggaaatca
 661 tatcaagtat tacagatagg gataataact gtaaactcag acttggtacc tgacttaaat
 721 cctaggatct ctcatacctt caacataaat gacaatagaa agtcatgttc tctagcactc
 781 ctaaatacag atgtatatca actgtgttca actccaaaag ttgatgaaag atcagattat
 841 gcatcatcag gcatagaaga tattgtactt gatattgtca attatgatag ctcaatctca
 901 acaacaagat taagaataa taatataagt tttgatcaac catatgcggc attataccca
 961 tctgttggac cagggatata ctacaaaggc aaaataatat ttctcgggta tggaggtctt
1021 gaacatccaa taaatgagaa tgcaatctgc aacacaactg agtgtcctgg aaaaacacag
1081 agagactgca atcaggcatc tcacagtcca tggttttcag atagaaggat ggtcaactct
1141 ataattgttg ttgacaaggg tttaaactca gttccaaaat gaaggtatg gtcgatatct
1201 atgagacaaa attactgggg gtcagaagga agattacttc tactaggtaa caagatctac
1261 atatacacaa gatctacaag ttggcacagc aagttacaat taggaataat tgacattact
1321 gactacagtg atataaggat aaaatggaca tggcataatg tgctatcaag accaggaaac
1381 aatgaatgtc catggggaca ttcatgtccg gatggatgta acgggagt atatactgat
1441 gcatatccac tcaatcccac aggaagcatt gtatcatctg tcatattgga ctcacaaaaa
1501 tcgagagtca acccagtcat aacttactca acagcaaccg aaagggtaaa cgagctggcc
1561 atccgaaaca aacactctc agctgggtat acaacaacaa gttgcattac acactataac
1621 aaagggtatt gttttcatat agtagaaata aatcataaaa gcttaaacac atttcaaccc
1681 atgttgttca aaacagagat tccaaaaagc tgcagttaa
```

FIG. 60B

MEYWKHTNHGKDAGNELETSMATNGNKLTNKITYILWTITLVLL
SIVFIIVLINSIKSEKAHESLLQDINNEFMEITEKIQMASDNTNDLIQSGVNTRLLTI
QSHVQNYIPISLTQQMSDLRKFISEITIRNDNQEVLPQRITHDVGIKPLNPDDFWRCT
SGLPSLMKTPKIRLMPGPGLLAMPTTVDGCIRTPSLVINDLIYAYTSNLITRGCQDIG
KSYQVLQIGIITVNSDLVPDLNPRISHTFNINDNRKSCSLALLNTDVYQLCSTPKVDE
RSDYASSGIEDIVLDIVNYDGSISTTRFKNNNISFDQPYAALYPSVGPGIYYKGKIIF
LGYGGLEHPINENVICNTTGCPGKTQRDCNQASHSPWFSDRRMVNSIIVVDKGLNSIP
KLKVWTISMRQNYWGSEGRLLLLGNKIYIYTRSTSWHSKLQLGIIDITDYSDIRIKWT
WHNVLSRPGNNECPWGHSCPDGCITGVYTDAYPLNPTGSIVSSVILDSQKSRVNPVIT
YSTATERVNELAIRNRTLSAGYTTTSCITHYNKGYCFHIVEINQKSLNTLQPMLFKTE
VPKSCS

FIG. 61A

```
   1 gacaaatcca aattcgagat ggaatactgg aagcatacca atcacggaaa ggatgctggc
  61 aatgagctgg agacgtccat ggctactaat ggcaacaagc tcaccaataa gataacatat
 121 atattatgga caataatcct ggtgttatta tcaatagtct tcatcatagt gctaattaat
 181 tccatcaaaa gtgaaaaggc tcatgaatca ttgctgcaag acataaataa tgagtttatg
 241 gaaattacag aaaagatcca aatggcatcg gataatacca atgatctaat acagtcagga
 301 gtgaatacaa ggcttcttac aattcagagt catgtccaga ttatatacc aatatcactg
 361 acacaacaga tgtcagatct taggaaattc attagtgaaa ttacaattag aaatgataat
 421 caagaagtgc tgccacaaag aataacacat gatgtgggta taaaaccttt aaatccagat
 481 gattttgga gatgcacgtc tggtcttcca tctttaatga aaactccaaa aataaggtta
 541 atgccagggc cgggattatt agctatgcca acgactgttg atggctgtat cagaactccg
 601 tccttagtta taatgatctc gatttatgct tatacctcaa atctaattac tcgaggttgt
 661 caggatatag gaaaatcata tcaagtctca cagataggga taataactgt aaactcagac
 721 ttggtacctg acttaaatcc caggatctct catactttta acataaatga caataggaag
 781 tcatgttctc tagcactcct aaatacagat gtatatcaac tgtgttcaac tcccaaagtt
 841 gatgaaagat cagattatgc atcatcaggc ataaagata ttgtacttga tattgtcaat
 901 tatgatggct caatctcaac aacaagattt aagaataata acataagctt tgatcaacct
 961 tatgctgcac tatacccatc tgttggacca gggatatact acaaaggcaa aataatattt
1021 ctcgggtatg gaggtcttga acatcaata aatgagaatg taatctgcaa cacaactggg
1081 tgtcccggga aaacacagag agactgcaat caggcatctc atagtccatg gttttcagat
1141 aggaggatgg tcaactctat cattgttgtt gacaaaggct taaactcaat tccaaaattg
1201 aaggtatgga cgatatctat gagacagaat tactgggggt cagaaggaag gttacttcta
1261 ctaggtaaca agatctatat atatacaaga tccacaagtt ggcatagcaa gttacaatta
1321 ggaataattg atattactga ttacagtgat ataaggataa aatggacatg cataatgtg
1381 ctatcaagac caggaaacaa tgaatgtcca tggggacatt catgtccaga tggatgtata
1441 acaggagtat atactgatgc atatccactc aatcccacag ggagcattgt gtcatctgtc
1501 atattagatt cacaaaaatc gagagtgaac ccagtcataa cttactcaac agcaaccgaa
1561 agagtaaacg agctggccat ccgaaacaga acactctcag ctggatatac aacaacaagc
1621 tgcatcacac actataacaa aggatattgt tttcatatag tagaaataaa tcagaaaagc
1681 ttaaacacac ttcaacccat gttgttcaag acagaggttc caaaagctg cagttaatca
1741 taattaaccg caatatgcat taacctatct ataatacaag tatatgataa gtaatcagca
1801 atcagacaat agacaaaagg gaaatataaa aa
```

FIG. 61B

NDV M

|  | | 212 | 223 | 228 | 239 | |
|---|---|---|---|---|---|---|
| SEQ ID NO. 293 | WT | VGVDPKSPLVKS | | DSGYYANLFLHI | | SEQ ID NO. 294 |
| SEQ ID NO. 295 | A$_{216}$A$_{219}$ | VGVDAKSALVKS | | DSGYYANLFLHI | | SEQ ID NO. 296 |
| SEQ ID NO. 297 | A$_{232}$A$_{235}$ | VGVDPKSPLVKS | | DSGYAANAFLHI | | SEQ ID NO. 298 |
| SEQ ID NO. 299 | YPDL | VGVDPKSPLVKS | | DSGYYPDLFLHI | | SEQ ID NO. 300 |
| SEQ ID NO. 301 | PTAP | VGVDPKSPLVKS | | DSGYPTAPFLHI | | SEQ ID NO. 302 |

FIG. 70A

Canine Distemper Virus Fusion Protein (Type 1 protein)

MHKGIPKSSKTQTHTQQDRPPQPSTELEETRTSRARHSTTSAQR

STHYDPRTSDRPVSYTMNRTRSRKQTSHRLKNIPVHGNHEATIQHIPESVSKGARSQI

ERRQPNAINSGSQCTWLVLWCLGMASLFLCSKAQIHWNNLSTIGIIGTDSVHYKIMTR

PSHQYLVIKLMPNVSLIENCTKAELGEYEKLLNSVLEPINQALTLMTKNVKPLQSLGS

GRRQRRFAGVVLAGVALGVATAAQITAGIALHQSNLNAQAIQSLRTSLEQSNKAIEEI

REATQETVIAVQGVQDYVNNELVPAMQHMSCELVGQRLGLRLLRYYTELLSIFGPSLR

DPISAEISIQALIYALGGEIHKILEKLGYSGSDMIAILESRGIKTKITHVDLPGKFII

LSISYPTLSEVKGVIVHRLEAVSYNIGSQEWYTTVPRYIATNGYLISNFDESSCVFVS

ESAICSQNSLYPMSPLLQQCIRGDTSSCARTLVSGTMGNKFILSKGNIVANCASILCK

CYSTSTIINQSPDKLLTFIASDTCPLVEIDGATIQVGGRQYPDMVYEGKVALGPAISL

DRLDVGTNLGNALKKLDDAKVLIDSSNQILETVRRSSFNFGSLLSVPILSCTALALLL

LIYCCKRRYQQTLKQHTKVDPAFKPDLTGTSKSYVRSL

FIG. 75

Cytomegalovirus gG Glycoprotein (Type 1 protein)

mesriwclvv cvnlcivclg aavsssstrg tsathshhss httsaahsrs gsvsqrvtss
qtvshgvnet iynttlkygd vvgvnttkyp yrvcsmaqgt dlirferniv ctsmkpined
ldegimvvyk rnivahtfkv rvyqkvltfr rsyayihtty llgsnteyva ppmweihhin
shsqcyssys rviagtvfva yhrdsyenkt mqlmpddysn thstryvtvk dqwhsrgstw
lyretcnlnc mvtittarsk ypyhffatst gdvvdispfy ngtnrnasyf genadkffif
pnytivsdfg rpnsalethr lvaflerads viswdiqdek nvtcqltfwe asertirsea
edsyhfssak mtatflskkq evnmsdsald cvrdeainkl qqifntsynq tyekygnvsv
fettgglvvf wqgikqkslv elerlanrss lnlthnrtkr stdgnnathl snmesvhnlv
yaqlqftydt lrgyinrala qiaeawcvdq rrtlevfkel skinpsails aiynkpiaar
fmgdvlglas cvtinqtsvk vlrdmnvkes pgrcysrpvv ifnfanssyv qygqlgedne
illgnhrtee cqlpslkifi agnsayeyvd ylfkrmidls sistvdsmia ldidplentd
frvlelysqk elrssnvfdl eeimrefnsy kqrvkyvedk vvdplppylk glddlmsglg
aagkavgvai gavggavasv vegvatflkn pfgaftiilv aiavviiiyl iytrqrrlcm
qplqnlfpyl vsadgttvts gntkdtslqa ppsyeesvyn sgrkgpgpps sdastaappy
tneqayqmll alvrldaeqr aqqngtdsld gqtgtqdkgq kpnlldrlrh rkngyrhlkd
sdeeenv

FIG. 76

Cytomegalovirus gH Glycoprotein (Type 1 protein)

```
MRPGLPSYLIILAVCLFSHLLSSRYGAEAVSEPLDKAFHLLLNTYGRPIRFLRENTTQCTYNSSLRNSTVVRENAIS
FNFFQSYNQYYVFHMPRCLFAGPLAEQFLNQVDLTETLERYQQRLNTYALVSKDLASYRSFSQQLKAQDSLGEQPTT
VPPPIDLSIPHVWMPPQTTPHGWTESHTTSGLHRPHFNQTCILFDGHDLLFSTVTPCLHQGFYLIDELRYVKITLTE
DFFVVTVSIDDDTPMLLIFGHLPRVLFKAPYQRDNFILRQTEKHELLVLVKKDQLNRHSYLKDPDFLDAALDFNYLD
LSALLRNSFHRYAVDVLKSGRCQMLDRRTVEMAFAYALALFAAARQEEAGAQVSVPRALDRQAALLQIQEFMITCLS
QTPPRTTLLLYPTAVDLAKRALWTPNQITDITSLVRLVYILSKQNQQHLIPQWALRQIADFALKLHKTHLASFLSAF
ARQELYLMGSLVHSMLVHTTERREIFIVETGLCSLAELSHFTQLLAHPHHEYLSDLYTPCSSSGRRDHSLERLTRLF
PDATVPATVPAALSILSTMQPSTLETFPDLFCLPLGESFSALTVSEHVSYIVTNQYLIKGISYPVSTTVVGQSLIIT
QTDSQTKCELTRNMHTTHSITVALNISLENCAFCQSALLEYDDTQGVINIMYMHDSDDVLFALDPYNEVVSSPRTH
YLMLLKNGTVLEVTDVVVDATDSRLLMMSVYALSAIIGIYLLYRMLKTC
```

FIG. 77

Cytomegalovirus gH Glycoprotein (Type 1 protein)

```
                        caatcagcat gtcttgagca tgcggtagag cagatagatg
109261 ccgatgatgg ccgatagcgc gtagacggac atcatgagga gacgactgtc ggtggcgtcc
109321 acgacgacgt cagttacttc tagtaccgta ccgtttttca aaagcatgag gtagtgagtt
109381 cgcggagatg agaccaccac ttcgttgtag ggatccaggg cgaaaaggac gtcgtccgag
109441 tcgtgcatgt acatgatgtt gatgacgcct tgcgtgtcgt cgtattctag cagggcgctt
109501 tggcaaaagg cgcagttttc tagcgaaatg ttgagcgcca ctgtgatgct gtgtgtggta
109561 tgcatgttgc gcgtcagttc gcatttagtt tgactgtccg tctgggtgat gatgaggctc
109621 tggcctacga cggtggtgga gacagggtag gagatacctt tgatcaggta ctggtttgtt
109681 acgatataac tgacgtgttc ggagacggtc agcgcggaga aggattcgcc gagcggcaag
109741 caaaacaggt cggggaaggt ttccagcgtg cttggttgca tggtagatag gatggagagg
109801 gcggcgggaa cggtagcggg gacggtggca tcggggaaga gacgcgtgag gcgttcgagc
109861 gagtgatcgc gtcgcccgct actggaacag ggtgtgtaca ggtcgctgag gtattcgtgg
109921 tgtggatgag ctaacaactg cgtaaagtgt gatagctcgg ccaatgaaca gaggcccgtt
109981 tctacgatga agatttcgcg tctctccgtc gtatgtacca gcatggagtg gacgaggctg
110041 cccatgaggt agagttcttg gcgtgcgaag gctgaaagaa aagaggccag gtgcgttttg
110101 tgtagtttta gggcaaagtc ggcgatctgt cgtagtgccc attgggggat gagatgttgc
110161 tgattctgtt tagagagtat gtagaccagg cgtacgaggc tggtgatgtc ggtgatctga
110221 ttcggtgtcc aaagggctcg tttggccagg tccacggccg tgggatacag cagcaacgtg
110281 gtgcgtggtg gtgtttgtga gaggcaggtg atcataaatt cttgtatttg taagagtgcg
110341 gcctggcggt ctagggcccg tgggacggag acttgggcgc cggcctcttc ttgtcgggct
110401 gctgcgaaca gtgctaatgc gtaggcgaag gccatttcta ccgtgcggcg gtccagcatc
110461 tgacatcgac cgctcttgag tacatccacg gcgtaacggt gaaagctgtt acgtagtagt
110521 gcgctgaggt ctaggtagtt gaagtcaagt gcggcgtcaa gaaagtccgg gtctttgaga
110581 taagagtgac ggttcagttg atctttctta actagcacca ggagctcgtg ttttcagtt
110641 tgtcgtagta taaagttgtc gcgttgatag ggcgctttga aaagtacgcg tggaagatgg
110701 ccgaagataa gcagcatggg tgtgtcgtcg tctatggaca ccgtaactac gaagaagtcc
110761 tcggtcagtg ttatttaac gtaacgtagt tcgtcgatga ggtaaaagcc ttggtgcaaa
110821 caaggtgtga cggtgctgaa tagtagatcg tgtccatcaa agaggataca ggtctggtta
110881 aagtgtggtc ggtgtagtcc tgaggtggta tgtgattctg tccagccgtg tggagtggtt
110941 tgcggtggca tccaaacgtg aggtattgac aggtcaatgg gcggtggcac agtggtgggc
111001 tgttcaccta ggctgtcttg tgcctttagc tgctgcgaaa aagatcggta gctggccagg
111061 tctttggata ccagcgcgta agtgttaagt ctctgttggt atctttccag ggtttcggtc
111121 agatctacct ggttcagaaa ctgctccgcc agaggacccg caaaaagaca tcgaggcata
111181 tggaatacat agtattgatt atagctttgg aaaagttgaa actgatggc gttttccctg
111241 acgaccgtgc tgttacggag gctgctgttg taggtacact gggtggtatt ttcacgcagg
111301 aagcggatgg gtctcccgta ggtgttgagc agtaggtgaa acgctttgtc cagcggttcg
111361 gatacggctt ctgcgccata tcgtgacgaa agtaggtggc tgaagagaca gacggcgagg
111421 atgatgaggt aggaggggag gcctggccgc atagcgcggc
```

FIG. 78

Ebola Virus Glycoprotein Precursor (Type 1 protein)

MGVTGILQLPRDRFKRTSFFLWVIILFQRTFSIPLGVIHNSTLQ

VSDVDKLVCRDKLSSTNQLRSVGLNLEGNGVATDVPSATKRWGFRSGVPPKVVNYEAG

EWAENCYNLEIKKPDGSECLPAAPDGIRGFPRCRYVHKVSGTGPCAGDFAFHKEGAFF

LYDRLASTVIYRGTTFAEGVVAFLILPQAKKDFFSSHPLREPVNATEDPSSGYYSTTI

RYQATGFGTNETEYLFEVDNLTYVQLESRFTPQFLLQLNETIYTSGKRSNTTGKLIWK

VNPEIDTTIGEWAFWETKKNLTRKIRSEELSFTVVSNGAKNISGQSPARTSSDPGTNT

TTEDHKIMASENSSAMVQVHSQGREAAVSHLTTLATISTSPQSLTTKPGPDNSTHNTP

VYKLDISEATQVEQHHRRTDNDSTASDTPSATTAAGPPKAENTNTSKSTDFLDPATTT

SPQNHSETAGNNNTHHQDTGEESASSGKLGLITNTIAGVAGLITGGRRTRREAIVNAQ

PKCNPNLHYWTTQDEGAAIGLAWIPYFGPAAEGIYIEGLMHNQDGLICGLRQLANETT

QALQLFLRATTELRTFSILNRKAIDFLLQRWGGTCHILGPDCCIEPHDWTKNITDKID

QIIHDFVDKTLPDQGDNDNWWTGWRQWIPAGIGVTGVIIAVIALFCICKFVF

FIG. 79

Ebola virus Glycoprotein Precursor (Type 1 protein)

```
                          g atgaagatta agccgacagt gagcgtaatc ttcatctctc
5941 ttagattatt tgttttccag agtaggggtc gtcaggtcct tttcaatcgt gtaaccaaaa
6001 taaactccac tagaaggata ttgtggggca acaacacaat gggcgttaca ggaatattgc
6061 agttacctcg tgatcgattc aagaggacat cattctttct ttgggtaatt atccttttcc
6121 aaagaacatt ttccatccca cttggagtca tccacaatag cacattacag gttagtgatg
6181 tcgacaaact agtttgtcgt gacaaactgt catccacaaa tcaattgaga tcagttggac
6241 tgaatctcga agggaatgga gtggcaactg acgtgccatc tgcaactaaa agatgggct
6301 tcaggtccgg tgtcccacca aaggtggtca attatgaagc tggtgaatgg gctgaaaact
6361 gctacaatct tgaaatcaaa aaacctgacg ggagtgagtg tctaccagca gcgccagacg
6421 ggattcgggg cttcccccgg tgccggtatg tgcacaaagt atcaggaacg ggaccgtgtg
6481 ccggagactt tgccttccat aaagagggtg ctttcttcct gtatgatcga cttgcttcca
6541 cagttatcta ccgaggaacg actttcgctg aaggtgtcgt tgcatttctg atactgcccc
6601 aagctaagaa ggacttcttc agctcacacc ccttgagaga gccggtcaat gcaacggagg
6661 acccgtctag tggctactat tctaccacaa ttagatatca ggctaccggt tttggaacca
6721 atgagacaga gtacttgttc gaggttgaca atttgaccta cgtccaactt gaatcaagat
6781 tcacaccaca gtttctgctc cagctgaatg agacaatata taagtggg aaaaggagca
6841 ataccacggg aaaactaatt tggaaggtca accccgaaat tgatacaaca atcggggagt
6901 gggccttctg ggaaactaaa aaacctcac tagaaaaatt cgcagtgaag agttgtcttt
6961 cacagttgta tcaaacggag ccaaaaacat cagtggtcag agtccggcgc gaacttcttc
7021 cgacccaggg accaacacaa caactgaaga ccacaaaatc atggcttcag aaaattcctc
7081 tgcaatggtt caagtgcaca gtcaaggaag ggaagctgca gtgtcgcatc taacaaccct
7141 tgccacaatc tccacgagtc cccaatccct cacaaccaaa ccaggtccgg acaacagcac
7201 ccataataca cccgtgtata aacttgacat ctctgaggca actcaagttg aacaacatca
7261 ccgcagaaca gacaacgaca gcacagcctc cgacactccc tctgccacga ccgcagccgg
7321 acccccaaaa gcagagaaca ccaacacgag caagagcact gacttcctgg accccgccac
7381 cacaacaagt ccccaaaacc acagcgagac cgctggcaac aacaacactc atcaccaaga
7441 taccggagaa gagagtgcca gcagcgggaa gctaggctta attaccaata ctattgctgg
7501 agtcgcagga ctgatcacag gcgggagaag aactcgaaga gaagcaattg tcaatgctca
7561 acccaaatgc aaccctaatt tacattactg gactactcag gatgaaggtg ctgcaatcgg
7621 actggcctgg ataccatatt tcgggccagc agccgaggga atttacatag agggctaat
7681 gcacaatcaa gatggtttaa tctgtgggtt gagacagctg ccaacgaga cgactcaagc
7741 tcttcaactg ttcctgagag ccacaactga gctacgcacc ttttcaatcc tcaaccgtaa
7801 ggcaattgat ttcttgctgc agcgatgggg cggcacatgc cacattctgg gaccggactg
7861 ctgtatcgaa ccacatgatt ggaccaagaa cataacagac aaaattgatc agattattca
7921 tgatttgtt gataaaaccc ttccggacca gggggacaat gacaattggt ggacaggatg
7981 gagacaatgg ataccggcag gtattggagt tacaggcgtt ataattgcag ttatcgcttt
8041 attctgtata tgcaaatttg tcttttagtt tttcttcaga ttgcttcatg gaaaagctca
8101 gcctcaaatc aatgaaacca ggatttaatt atatggatta cttgaatcta agattacttg
8161 acaaatgata atataataca ctggagcttt aaacatagcc aatgtgattc taactccttt
8221 aaactcacag ttaatcataa acaaggtttg acatcaatct agttatctct ttgagaatga
8281 taaacttgat gaagattaag aaaaaggtaa tctttcgatt atctttaatc ttcatccttg
8341 attctacaat catgacagtt gtctttagtg acaagggaaa gaagcctttt tattaagttg
8401 taata
```

FIG. 80

HIV Envelope Protein (Type 1 protein)

MRVKEIRRNYQHLWRWGTMLLGILMICSAAEKLWVTVYYGVPVW

KEANTTLFCASDAKATKAEVHNVWATHACVPTDPNPQELALENVTEKFDMWKNNMVEQ

MHEDIISLWDQSLKPCVKLTPLCVTLTCTDYSGNNNTNITGKANTTIDDIEMKNCSFN

ITTGIRDKVKREYALFYKVDVVPIEKNTSYRLIHCNTSTITQACPKVSFEPIPIHYCA

PAGFAILKCKDKKFNGTGLCTNVSTVQCTHGIRPVVSTQLLLNGSLAEEEVVIRSQNF

TDNVKTIIVQLNESVVINCTRPNNNTRKSIHIGPGGAFYTTGQVIGNIRQAYCNISEE

QWNKTLKYIVEKLREQFGNKTIIFNQSSGGDPEIVTHSFNCGGEFFYCNTSRLFNSTW

NITEGSNSTAGSNKNITLPCRIKQIINMWQEVGKAMYAPPISGLIRCTSNITGLLLTR

DGGHDNKTNDTEIFRPGGGNMRDNWRSELYKYKVVKIEPLGIAPTKARRRVVQRDKRA

VGIGAMFLGILGAAGSTMGAASITLTVQARQLLSGIVQQQNNLLRAIEAQQHLLQLTV

WGIKQLQARVLAVERYLKDQQLLGIWGCSGKLICTTNVPWNTSWSNRSLDYIWGNMTW

IQWEREIDNYTDLIYTLIEESQDQQEKNELELMKLDKWDSLWSWFSITNWLWYIRLFI

IIVGGLVGLRIVFTVLSIVNRVRQGYSPLSFQTRLQAPRGPDRPEGIEEEGGDRDRDR

SVRLVDGFLALLWEDLRSLFLFSYRHLRDLLLIVARTVELLGRRGREALKYGWNLLLY

WSQELKNSAVSLLNATAITVAEGTDRAIELIQRAFRAFLRIPTRIRQGLERALL

FIG. 81

HIV Envelope Protein (Type 1 protein)

```
                                                                 tgtgggtcac
5581 agtctattat ggggtaccag tgtggaaaga agcaaacacc actctatttt gtgcatcaga
5641 tgctaaagca actaaggcag aggtacataa tgtttgggct acacatgcct gtgtacccac
5701 ggaccccaac ccacaagaac tagcattgga aaatgtgaca gaaaagtttg acatgtggaa
5761 aaataacatg gtagaacaga tgcatgagga tataatcagt ttatgggatc aaagcctaaa
5821 gccatgtgta aaattaaccc cactctgtgt taccttaact tgtactgatt attcggggaa
5881 taataatact aatatcactg gaaggctaa taccactatt gatgatatag aaatgaaaaa
5941 ttgctctttc aatattacca caggcataag agataaggtg aagagagaat atgcactgtt
6001 ttataaagtt gatgtagtac caatagagaa gaataccagt tataggttga tacattgtaa
6061 cacctcaacc atcacacagg cctgtccaaa ggtatccttt gagccaattc ccatacatta
6121 ctgtgccccg gctggttttg cgattctaaa gtgtaaagat aagaagttca atggaacagg
6181 actatgtaca aatgtcagca cagtacagtg tacacatgga attaggccag tagtgtcaac
6241 tcaactgctg ttaaatggta gtctagcaga agaagaggta gtaattagat ctcagaattt
6301 cacagacaat gtcaaaacca atatagtaca gctgaatgaa tctgtagtga ttaattgtac
6361 aagacccaac aataatacaa gaaaaagtat acatatagga ccaggggag cattctatac
6421 aacaggacaa gtaataggaa atataagaca ggcatattgc aacattagtg aagaacaatg
6481 gaataaaact ttaaaataca tagttgaaaa attaagagaa caatttggaa ataaaacaat
6541 aatctttaat caatcctcag gaggggatcc agaaattgta acgcacagtt taattgtgg
6601 aggagaattc ttctactgta atacatcacg gctgtttaat agtacttgga atattactga
6661 agggtcaaat agcactgcag gctctaacaa gaatatcaca ctcccatgca ggataaaaca
6721 aattataaac atgtggcagg aagtaggaaa agcaatgtat gcccctccca tcagcggact
6781 aattagatgt acatcaaata ttacagggct gttactaaca agagatggtg gtcatgataa
6841 taaaacaaat gacaccgaga tcttcagacc tggaggagga aacatgaggg acaattggag
6901 aagtgaatta tataaatata agtagtaaa aattgaacca ttaggaatag cacccaccaa
6961 ggcaaggaga agagtggtgc aaagagacaa aagagcagtg gaataggag ctatgttcct
7021 tgggatctta ggagcagcag gaagcactat gggcgcagcg tcaataacgc tgacggtaca
7081 ggccagacaa ctattgtctg gtatagtgca acagcagaac aatttgctga gggccattga
7141 ggcgcaacag catctgttgc aactcacagt ctggggcata agcaactcc aggcaagagt
7201 cctggctgtg gaaagatacc taaaggatca acagctccta gggatttggg gatgctctgg
7261 aaaactcatc tgcaccacta atgtgccttg aatactagt tggagtaata gatctctgga
7321 ctatatttgg ggaacatga cctggataca gtgggaaagg gaaattgaca attacacaga
7381 cttaatatac accttaattg aagaatcgca agaccaacaa gaaaagaatg aactagaatt
7441 aatgaaacta gataagtggg acagtctgtg gagttggttt agcataacaa actggctgtg
7501 gtatataaga ttattcataa ttatagtagg aggcttagta ggtttaagaa tagtttttac
7561 tgtactttct atagtgaata gagttaggca gggatactca ccattgtcat ttcagacccg
7621 cctccaagcc cccaggggac ccgacaggcc cgaaggaatc gaagaagaag gtggagacag
7681 agacagagac agatccgtgc gcttagtgga tggattctta gcacttctct gggaagatct
7741 gaggagcctg ttcctcttca gctaccgcca cttgagagac ttactcttga ttgtagcgag
7801 gactgtggaa cttctgggac gcaggggag gaagccctc aaatacggt ggaatcttct
7861 gctgtattgg agtcaggaac taaagaatag tgctgttagt ttgctcaatg ctacagctat
7921 aacagtagct gaggggacag atagggctat agaactaata caaagagctt ttagggcttt
7981 tcttcgcata cctacaagaa taagacaggg cttggaaagg ctttgctat aaaatgggtg
```

FIG. 82

Herpes Simplex Virus gH Glycoprotein (Type 1 protein)

MGNGLWFVGVIILGAAWGQVHDWTEQTDPWFLDGLGMDRMYWRD

TNTGRLWLPNTPDPQKPPRGFLAPPDELNLTTASLPLLRWYEERFCFVLVTTAEFPRD

PGQLLYIPKTYLLGRPPNASLPAPTTVEPTAQPPPAVAPLKGLLHNPTASVLLRSRAW

VTFSAVPDPEALTFPRGDNVATASHPSGPRDTPPPRPPVGARRHPTTELDITHLHNAS

TTWLATRGLLRSPGRYVYFSPSASTWPVGIWTTGELVLGCDAALVRARYGREFMGLVI

SMHDSPPAEVMVVPAGQTLDRVGDPADENPPGALPGPPGGPRYRVFVLGSLTRADNGS

ALDALRRVGGYPEEGTNYAQFLSRAYAEFFSGDAGAEQGPRPPLFWRLTGLLATSGFA

FVNAAHANGAVCLSDLLGFLAHSRALAGLAARGAAGCAADSVFFNVSVLDPTARLQLE

ARLQHLVAEILEREQSLALHALGYQLAFVLDSPSAYDAVAPSAAHLIDALYAEFLGGR

VVTTPVVHRALFYASAVLRQPFLAGVPSAVQRERARRSLLIASALCTSDVAAATNADL

RTALARADHQKTLFWLPDHFSPCAASLRFDLDESVFILDALAQATRSETPVEVLAQQT

HGLASTLTRWAHYNALIRAFVPEASHRCGGQSANVEPRILVPITHNASYVVTHSPLPR

GIGYKLTGVDVRRPLFLTYLTATCEGSTRDIESKRLVRTQNQRDLGLVGAVFMRYTPA

GEVMSVLLVDTDNTQQQIAAGPTEGAPSVFSSDVPSTALLLFPNGTVIHLLAFDTQPV

AAIAPGFLAASALGVVMITAALAGILKVLRTSVPFFWRRE

FIG. 83

Herpes Simplex Virus gH Glycoprotein (Type 1 protein)

```
   1 atggggaatg gtttatggtt cgtgggggtt attattttgg gcgctgcgtg gggtcaggtc
  61 cacgactgga ctgagcagac agatccatgg tttttggatg gcctgggcat ggaccgcatg
 121 tactggcgcg acacgaacac cgggcgtctg tggctgccaa acacccccga cccccaaaaa
 181 ccaccgcgcg gatttctggc gccgcggac gaactaaacc tgactacggc atctctgccc
 241 cttcttcgct ggtacgagga gcgcttttgt tttgtattgg tcaccacggc cgagtttccg
 301 cgggaccccg gccagctgct ttacatcccg aagacctacc tgctcggccg gcccccgaac
 361 gcgagcctgc ccgcccccac cacggtcgag ccgaccgccc agcctccccc cgcggtcgcc
 421 cccttaagg gtctcttgca caatccaacc gcctccgtgt tgctgcgttc ccggccctgg
 481 gtaacgtttt cggccgtccc tgaccccgag gccctgacgt cccgcgggg agacaacgtg
 541 gcgacagcga gccacccgag cgggccgcgt gataccgc ccccgacc gccggttggg
 601 gcccggcggc atccgacgac ggagctggac atcacgcacc tgcacaacgc gtccacgacc
 661 tggttggcca cccggggcct gttgagatcc ccaggtaggt acgtgtattt ctcccgtcg
 721 gcctcgacgt ggcccgtggg catctggacg acgggggagc tggtgctcgg gtgcgatgcc
 781 gcgctggtgc gcgcgcgcta cgggcgggaa ttcatggggc tcgtgatatc catgcacgac
 841 agccctccgg cggaagtgat ggtggtcccc gcgggccaga cgctagatcg ggtcggggac
 901 cccgcggacg aaaaccccc ggggctctt cccgggcccc cgggcggccc ccggtatcgg
 961 gtctttgtcc tagggtccct gacgcgggcc gacaacggct ccgcgctgga cgccctccgc
1021 cgcgtgggcg ctaccccgga ggagggcacg aactacgccc agttcctgtc gcgggcatac
1081 gcggagtttt tctcggggga cgcgggcgcc gagcagggcc gcgcccccc tctcttctgg
1141 cgcctaacgg ggctgctcgc gacgtcgggt tttgctttcg tgaacgccgc ccacgcaaac
1201 ggcgcggtct gcctctccga cctgctaggc ttttggccc actcgcgcgc gcttgccggg
1261 ttggccgccc gcggggccgc gggctgtgcc gcggattctg tgttttttaa tgtgtcagtc
1321 ttggatccca cggcccgcct gcagctagag gctcggctcc agcacctggt ggccgagatt
1381 ctggagcgcg aacagagctt ggcattacac gcgctgggct atcagctggc cttcgtgctg
1441 gatagccct cggcgtacga cgcagtggcg cccagcgcag cccatctcat cgacgcccctg
1501 tatgccgagt ttctaggggg ccgcgtcgtg accacccgg tcgtccaccg ggcgctattt
1561 tacgcctcgg ctgtcctccg gcagccgttc ttggcgggcg tcccctcggc ggtgcagcgg
1621 gaacgcgccc gccggagcct tctgatagcc tcggccctgt gtacgtccga cgtcgccgca
1681 gcgaccaacg ccgacctccg gaccgcgctg gcccgggccg accaccagaa aacctctttt
1741 tggcttccgg accactttc gccatgcgcg gcctccctgc gctttgatct agacgagagc
1801 gtgtttatcc tggacgcgct ggctcaagcc acccgatccg agaccccggt cgaagtcctg
1861 gcccagcaga cccacggcct cgcctcgacc ctgacgcgct gggcacacta caacgccctg
1921 atccgcgcct tcgtccctga ggcctcacat cggtgcgggg ggcagtctgc caacgtcgag
1981 ccacggatcc tggtacccat cacccacaac gccagctacg tcgtcaccca ctcccctctg
2041 ccccggggga tcggctacaa gctcaccggc gtcgacgtcc gacgccact gttcctaacc
2101 tacctcaccg cgacatgcga aggctccacc cgggatatcg agtccaagcg gctggtgcgc
2161 acccaaaacc agcgcgacct ggggctcgtg ggggccgtgt tatgcgcta cacccggcc
2221 ggggaggtca tgtctgtgtt gttggtggat acggacaaca cacagcagca atcgccgcc
2281 gggccgacgg agggcgcccc aagcgtgttt tcgagcgacg tgccgtccac ggccttgttg
2341 ctatttccaa acggaaccgt cattcatttg ctagccttg acacgcagcc cgtggccgca
2401 attgcgcccg ggtttctggc cgcctctgcg ctgggcgtgg ttatgattac cgccgccctg
2461 gctggcatcc taaaggttct ccggacaagt gtcccgtttt tttggagacg cgaataa
```

FIG. 84

Herpes Simplex Virus Glycoprotein gL (Type 1 protein)

MGILGWVGLIAVGILCVRGGLPSTEYVIRSRVAREVGDILKVPC

VPLPSDDLDWRYETPSAINYALIDGIFLRYHCPGLDTVLWDRHAQRAYWVNPFLFGAG

FLEDLSHPAFPADTQETETRLALYKEIRQALDSRKQAASHTPVKAGCVNFDYSRTRRC

VGRQDLGLTNRTSGRTPVLPSDDEAGLQPKPLTTPSPIIATSDPTPRRDAATKSRRRR

PHFRGL

FIG. 85

Herpes Simplex Virus Glycoprotein gL (Type 1 protein)

```
  1 atgggattt tgggttgggt cgggcttatt gccgttggga ttttgtgtgt gcggggggc
 61 ttgccttcaa ccgaatatgt tattcggagt cgggtggctc gagaggtggg ggatatatta
121 aaggtgcctt gtgtgccgct cccgtctgac gatcttgatt ggcgctacga gacccctcg
181 gctataaact atgctttgat agacggtata ttttgcgtt atcactgtcc cggattggac
241 acggtcttgt gggataggca cgcccagagg gcgtattggg ttaacccctt tttgtttggg
301 gcgggttttt tggaggactt gagtcatccc gcgtttcctg ccgacaccca ggaaacagaa
361 acgcgcttgg ccctttataa agagatacgc caggcgctgg acagtcgcaa gcaggccgcc
421 agccacacac ctgtgaaggc tgggtgtgtg aactttgact attcgcgcac ccgccgctgt
481 gtagggcgcc aggatttggg acttaccaac agaacgtctg gacggacccc ggttctgccg
541 tcggacgatg aagcgggcct gcagccgaag cccctcacca cgccgtcgcc catcatcgcc
601 acgtcggacc ccaccccgcg acgggacgcc gccacaaaaa gcagacgccg acgacccccac
661 ttccggggcc tttaa
```

FIG. 86

Influenza Virus HA-Type H1 (Type 1 protein)

```
mkaiplvlly tftaanadtl cigyhannst dtvdtvlekn vtvthsvnll edrhngklck
lggiaplhlg kcniagwllg npeceslsti sswsyivets nsdngtcypg dfinyeelre
qlssvssfer feifpkassw pnhetnggvt tacpyagaks fyrnliwlvk kgnsypklsk
syvnnkgkev lvlwgihhpp tsndqqalyq nadayvfvgs skynkmfkpe iatrpkvrnq
tgrmnyywtl vepgdtitfe atgnlvvpry afamnrgses giiisdtpvh dcnttcqtpk
gaintslpfq nvhpatigec pkyvkstklr matglrnips iqsrglfgai agfieggwtg
midgwygyhh qngqgsgyaa dqkstqnaid gitnkvnsvi ekmntqftav gkefnhlekr
ienlnkkvdd gfldvwtyna ellvllener tldfhdsnvk nlyekvrsql rnnakeigng
cfefyhkcdd tcmesvkngt ydyskysees klnrevidgv kldstriyqi laiystvass
lvllvslgai sfwmcsngsl qcricidfrd mrkntl
```

FIG. 87

Influenza Virus B HA (Type 1 protein)

```
mkaiivllmv vtsnadrict gitssnsphv vktatqgevn vtgviplttt ptkshfanlk
gtqtrgklcp ncfnctdldv algrpkcmgn tpsakvsilh evkpatsgcf pimhdrtkir
qlpnllrgye nirlstsnvi ntetapggpy kvgtsgscpn vangngffnt mawvipkdnn
ktainpvtve vpyicseged qitvwgfhsd dktqmerlyg dsnpqkftss angvtthyvs
qiggfpnqte deglkqsgri vvdymvqkpg ktgtivyqrg illpqkvwca sgrskvikgs
lpligeadcl hekygglnks kpyytgehak aigncpiwvk tplklangtk yrppakllke
rgffgaiagf leggwegmia gwhgytshga hgvavaadlk stqeainkit knlnylsele
vknlqrlsga mnelhdeile ldekvddlra dtissqiela vllsnegiin sedehllale
rklkkmlgps aveigngcfe tkhkcnqtcl driaagtfna gdfslptfds lnitaaslnd
dgldnhtill yystaassla vtlmiaifiv ymvsrdnvsc sicl
```

FIG. 88

Influenza Virus B HA Malaysia (Type 1 protein)

LSTHGSTSNADRICTGITSSNSPHVVKTATQGEVNVTGVIPLTT

TPTKSHFANLKGTETRGKLCPKCLNCTDLDVALGRPKCTGNIPSARVSILHEVRPVTS

GCFPIMHDRTKIRQLPKLLRGYEHIRLSTHNVINAENAPGGPYKIGTSGSCPNVTNGN

GFFATMAWAVPKNDNNKTATNSLTIEVPYICTEGEDQITVWGFHSDNETQMAKLYGDS

KPQKFTSSANGVTTHYVSQIGGFPNQTEDGGLPQSGRIVVDYMVQKSGKTGTITYQRG

ILLPQKVWCASGRSKVIKGSLPLIGEADCLHEKYGGLNKSKPYYTGEHAKAIGNCPIW

VKTPLKLANGTKYRPPAKLLKERGFFGAIAGFLEGGWEGMIAGWHGYTSHGAHGVAVA

ADLKSTQEAINKITKNLNSLSELEVKNLQRLSGAMDELHNEILELDEKVDDLRADTIS

SQIELAVLLSNEGIINSEDEHLLALERKLKKMLGPSAVEIGNGCFETKHKCNQTCLDR

IAAGTFDAGEFSLPTFDSLNITAASLNDDGLDNHTILLYYSTAASSLAVTLMIAIFVV

YMVSRDNVSCSICL

FIG. 89

Influenza Virus HA From Influenza B Malaysia (Type 1 protein)

```
   1 ttgtctactc atggtagtac atccaatgca gatcgaatct gcactgggat aacatcgtca
  61 aactcaccac atgttgtcaa aactgctact caaggggagg tcaatgtgac tggtgtaata
 121 ccactgacaa caacacccac caaatctcat tttgcaaatc tcaaaggaac agaaaccaga
 181 gggaaactat gcccaaaatg cctcaactgc acagatctgg acgtggcctt gggcagacca
 241 aaatgcacgg ggaacatacc ctcggcaaga gtttcaatac tccatgaagt cagacctgtt
 301 acatctgggt gctttcctat aatgcacgac agaacaaaaa ttagacagct gcctaaactt
 361 ctcagaggat acgaacatat caggttatca actcataacg ttatcaatgc agaaaatgca
 421 ccaggaggac cctacaaaat tggaacctca gggtcttgcc ctaacgttac caatggaaac
 481 ggatttttcg caacaatggc ttgggccgtc ccaaaaaacg acaacaacaa aacagcaaca
 541 aattcattaa caatagaagt accatacatt tgtacagaag gagaagacca aattaccgtt
 601 tggggggttcc actctgataa cgaaacccaa atggcaaagc tctatgggga ctcaaagccc
 661 cagaagttca cctcatctgc caacggagtg accacacatt acgtttcaca gattggtggc
 721 ttcccaaatc aaacagaaga cggaggacta ccacaaagtg gtagaattgt tgttgattac
 781 atggtgcaaa aatctgggga aacaggaaca attacctatc aaagaggtat tttattgcct
 841 caaaaagtgt ggtgcgcaag tggcaggagc aaggtaataa aaggatcctt gcctttaatt
 901 ggagaagcag attgcctcca cgaaaaatac ggtggattaa acaaaagcaa gccttactac
 961 acagggggaac atgcaaaggc cataggaaat tgcccaatat gggtgaaaac acccttgaag
1021 ctggccaatg gaaccaaata tagacctcct gcaaaactat taaggaaag gggtttcttc
1081 ggagctattg ctggtttctt agaaggagga tgggaaggaa tgattgcagg ttggcacgga
1141 tacacatccc atggggcaca tggagtagcg gtggcagcag accttaagag cactcaagag
1201 gccataaaca gataacaaa aatctcaac tctttgagtg agctggaagt aaagaatctt
1261 caaagactaa gcggtgccat ggatgaactc cacaacgaaa tactagaact agacgagaaa
1321 gtggatgatc tcagagctga tacaataagc tcacaaatag aactcgcagt cctgctttcc
1381 aatgaaggaa taataaacag tgaagatgag catctcttgg cgcttgaaag aaagctgaag
1441 aaaatgctgg gcccctctgc tgtagagata gggaatggat gctttgaaac caaacacaag
1501 tgcaaccaga cctgtctcga cagaatagct gctggtacct tgatgcagg agaattttct
1561 ctccccactt ttgattcact gaatattact gctgcatctt taatgacga tggattggat
1621 aatcatacta tactgcttta ctactcaact gctgcctcca gtttggctgt aacattgatg
1681 atagctatct ttgttgttta tatggtctcc agagacaatg tttcttgctc catctgtcta
1741 taaggaaagt taaaccctgt attttccttt attgtagtgc ttgtttgctt gttaccatta
1801 caaaaaacgt tattgaaaaa tgctcttgtt actact
```

FIG. 90

Influenza Virus HA Second Representative H1 (Type 1 protein)

MKVKLLVLLCTFTATYADTICIGYHANNSTDTVDTVLEKNVTVT

HSVNLLEDSHNGKLCLLKGIAPLQLGNCSVAGWILGNPECELLISKESWSYIVETPNP

ENGTCYPGYFADYEELREQLSSVSSFERFEIFPKESSWPNHXVTGVSASCSHNGKSSF

YRNLLWLTGKNGLYPNLSKSYANNKEKEVLVLWGVHHPPNIXDQRALYHTENAYVSVV

SSHYSRRFTPEIAKRPKVRDQEGRINYYWTLLEPGDTIIFEANGNLIAPRFAFALSRG

FGSGIITSNAPMDECDAKCQTPQGAINSSLPFQNVHPVTIGECPKYVRSTKLRMVTGL

RNIPSIQSRGLFGAIAGFIEGGWTGMVDGWYGYHHQNEQGSGYAADQKSTQNAINGIT

NKVNSVIEKMNTQFTAVGKEFNKLERRMENLNKKVDDGFLDIWTYNAELLVLLENERT

LDFHDSNVKNLYEKVKSQLKNNAKEIGNGCFEFYHKCNDECMESVKNGTYDYPKYSEE

SKLNREKIDGVKLESMGVYQILAIYSTVASSLVLLVSLGAISFWMCSNGSLQCRICI

FIG. 91

Influenza Virus HA Second Representative H1 (Type 1 protein)

```
   1 atgaaagtaa aactactggt tctgttatgt acatttacag ctacatatgc agacacaata
  61 tgtataggct accatgccaa caactcgacc gacactgttg acacagtact tgagaagaat
 121 gtgacagtga cacactctgt caacctactt gaggacagtc acaatggaaa actatgtcta
 181 ctaaaaggaa tagccccact acaattgggt aattgcagcg ttgccggatg gatcttagga
 241 aacccagaat gcgaattact gatttccaag gaatcatggt cctacattgt agagacacca
 301 aatcctgaga atggaacatg ttacccaggg tatttcgccg actatgagga gctgagagag
 361 caattgagtt cagtatcttc atttgagagg ttcgaaatat tccccaaaga gagctcatgg
 421 cccaaccaca ycgtaaccgg agtatcagca tcatgctccc ataacgggaa aagcagtttt
 481 tacagaaatt gctatggct gacggggaag aatggtttgt atccaaacct gagcaagtcc
 541 tatgcaaaca acaaagagaa agaagtcctt gtactgtggg gtgttcatca cccgcctaac
 601 atargggacc aaagggccct ctatcataca gaaaatgctt atgtctctgt agtgtcttca
 661 cattatagca gaagattcac cccagaaata gccaaaagac caaggtgaga gatcaggaa
 721 ggaagaatca actactactg gactctgctt gaacccgggg atacaataat atttgaggca
 781 aatggaaatc taatagcgcc aaggtttgct ttcgcactga gtagaggctt tggatcagga
 841 atcatcacct caaatgcacc aatggatgaa tgtgatgcga atgtcaaac cctcaggga
 901 gctataaaca gcagtcttcc tttccagaat gtacacccag tcacaatagg agagtgtcca
 961 aagtatgtca ggagtacaaa attaagaatg gttacaggac taaggaacat cccatccatt
1021 caatccagag gtttgtttgg agccattgcc ggtttcattg aaggggggtg gactggaatg
1081 gtagatggat ggtatggtta ccaccatcag aatgagcaag gatctgggta tgctgctgat
1141 caaaaaagca cacaaaatgc cattaacggg attacaaaca aggtgaattc tgtaattgag
1201 aaaatgaaca ctcaattcac agctgtgggc aaagaattca caaattgga agaaggatg
1261 gaaaacttaa ataaaaagt tgatgatggg tttctagaca tttggacata taacgcagaa
1321 ttgttggttc tactggaaaa tgaaaggact ttggactttc atgactccaa cgtgaagaat
1381 ctgtatgaga aagtaaaaag ccaattaaag aataatgcca agaaatagg aaacgggtgt
1441 tttgaattct atcacaagtg taacgatgaa tgcatggaga gtgtgaaaaa tggaacttat
1501 gactatccaa atattccga agaatcaaag ttgaacaggg agaaaattga tggagtgaaa
1561 ttggaatcaa tgggagtcta tcagattttg gcgatctact caacagtcgc cagttccctg
1621 gttcttttgg tctccctggg ggcaatcagc ttctggatgt gttccaatgg gtctttgcag
1681 tgtagaatat gcatctaa
```

FIG. 92

Influenza Virus HA Representative H3 (Type 1 protein)

MKTIIALSYILCLVFAQKLPGNDNSTATLCLGHHAVPNGTIVKT

ITNDQIEVTNATELVQSSSTGGICDSPHQILDGENCTLIDALLGDPQCDGFQNKKWDL

FVERSKAYSNCYPYDVPDYASLRSLVASSGTLEFNNESFNWTGVTQNGTSSACKRGSN

KSFFSRLNWLTHLKFKYPALNVTMPNNEKFDKLYIWGVHHPGTDNDQISLYAQASGRI

TVSTKRSQQTVIPNIGSRPRVRDIPSRISIYWTIVKPGDILLINSTGNLIAPRGYFKI

RSGKSSIMRSDAPIGKCNSECITPNGSIPNDKPFQNVNRITYGACPRYVKQNTLKLAT

GMRNVPEKQTRGIFGAIAGFIENGWEGMVDGWYGFRHQNSEGTGQAADLKSTQAAINQ

INGKLNRLIGKTNEKFHQIEKEFSEVEGRIQDLEKYVEDTKIDLWSYNAELLVALENQ

HTIDLTDSEMNKLFERTKKQLRENAEDMGNGCFKIYHKCDNACIGSIRNGTYDHDVYR

DEALNNRFQIKGVELKSGYKDWILWISFAISCFLLCVALLGFIMWACQKGNIRCNICI

FIG. 93

Influenza Virus HA Representative H3 (Type 1 protein)

```
   1 atgaagacta tcattgcttt gagctacatt ctatgtctgg ttttcgctca aaaacttccc
  61 ggaaatgaca acagcacggc aacgctgtgc cttgggcacc atgcagtacc aaacggaaca
 121 atagtgaaaa caatcacgaa tgaccaaatt gaagttacta atgctactga gctggttcag
 181 agttcctcaa caggtggaat atgcgacagt cctcatcaga tccttgatgg agaaaactgc
 241 acactaatag atgctctatt gggagaccct cagtgtgatg gcttccaaaa taagaaatgg
 301 gacctttttg ttgaacgcag caaagcctac agcaactgtt acccttatga tgtgccggat
 361 tatgcctccc ttaggtcact agttgcctca tccggcacac tggaatttaa caatgaaagc
 421 ttcaattgga ctggagtcac tcaaaatgga acaagctctg cttgcaaaag gggatctaat
 481 aaaagttttc ttagtagatt gaattggttg acccacttaa aattcaaata cccagcattg
 541 aacgtgacta tgccaaacaa tgaaaatttt gacaaattgt acatttgggg ggttcaccac
 601 ccgggtacgg acaatgacca aatcagccta tatgctcaag catcaggaag aatcacagtc
 661 tctaccaaaa gaagccaaca aactgtaatc ccgaatatcg gatctagacc cagggtaagg
 721 gatatcccca gcagaataag catctattgg acaatagtaa accgggaga catactttg
 781 attaacagca cagggaatct aattgctcct cggggttact tcaaaatacg aagtgggaaa
 841 agctcaataa tgagatcaga tgcacccatt ggcaaatgca attctgaatg catcactcca
 901 aatggaagca ttcccaatga caaaccattt caaaatgtaa acaggatcac atatgggggcc
 961 tgtcccagat atgttaagca aaacactctg aaattggcaa cagggatgcg aaacgtacca
1021 gagaaacaaa ctagaggcat atttggcgca atcgcgggtt tcatagaaaa tggttgggag
1081 ggaatggtgg acggttggta cggtttcagg catcaaaatt ctgagggaac aggacaagca
1141 gcagatctca aaagcactca agcagcaatc aaccaaatca tgggaagct gaataggttg
1201 atcgggaaaa caaacgaaaa attccatcag attgaaaaag aattctcaga agtagaaggg
1261 agaattcagg acctcgagaa atatgttgag gacactaaaa tagatctctg gtcatacaac
1321 gcggagcttc ttgttgccct ggagaaccaa catacaattg atctaactga ctcagaaatg
1381 aacaaactgt ttgaaagaac aaagaagcaa ctgagggaaa atgctgagga tatggcaat
1441 ggttgtttca aaatatacca caatgtgac aatgcctgca tagggtcaat cagaaatgga
1501 acttatgacc atgatgtata cagagatgaa gcattaaaca accggttcca gatcaaaggt
1561 gttgagctga agtcaggata caaagattgg atcctatgga tttcctttgc catatcatgt
1621 tttttgcttt gtgttgcttt gttggggttc atcatgtggg cctgccaaaa aggcaacatt
1681 aggtgcaaca tttgcatttg agtgca
```

FIG. 94

Influenza Virus HA Representative H5 HA (Type 1 protein)

MEKIVLLLAIVSLVKSDQICIGYHANNSTEQVDTIMEKNVTVTH
AQDILEKTHNGKLCDLNGVKPLILRDCSVAGWLLGNPMCDEFINVPEWSYIVEKASPA
NDLCYPGDFNDYEELKHLLSRTNHFEKIQIIPKSSWSNHDASSGVSSACPYHGRSSFF
RNVVWLIKKNSAYPTIKRSYNNTNQEDLLVLWGIHHPNDAAEQTKLYQNPTTYISVGT
STLNQRLVPEIATRPKVNGQSGRMEFFWTILKPNDAINFESNGNFIAPEYAYKIVKKG
DSAIMKSELEYGNCNTKCQTPMGAINSSMPFHNIHPLTIGECPKYVKSNRLVLATGLR
NTPQRERRRKKRGLFGAIAGFIEGGWQGMVDGWYGYHHSNEQGSGYAADKESTQKAID
GVTNKVNSIIDKMNTQFEAVGREFNNLERRIENLNKQMEDGFLDVWTYNAELLVLMEN
ERTLDFHDSNVKNLYDKVRLQLRDNAKELGNGCFEFYHKCDNECMESVKNGTYDYPQY
SEEARLNREEISGVKLESMGTYQILSIYSTVASSLALAIMVAGLSLWMCSNGSLQCRI
CI

FIG. 95

Influenza Virus HA Representative H5 HA (Type 1 protein)

```
   1 gcagggtat aatctgtcaa aatggagaaa atagtgcttc ttcttgcaat agtcagtctt
  61 gtcaaaagtg atcagatttg cattggttac catgcaaaca actcgacaga gcaggttgac
 121 acaataatgg aaaagaacgt tactgttaca catgcccaag acatactgga aaagacacac
 181 aatgggaagc tctgcgatct aaatggagtg aagcctctca ttttgagaga ttgtagtgta
 241 gctggatggc tcctcggaaa ccctatgtgt gacgaattca tcaatgtgcc ggaatggtct
 301 tacatagtgg agaaggccag tccagccaat gacctctgtt acccagggga tttcaacgac
 361 tatgaagaac tgaaacacct attgagcaga caaaccatt ttgagaaaat tcagatcatc
 421 cccaaaagtt cttggtccaa tcatgatgcc tcatcagggg tgagctcagc atgtccatac
 481 catgggaggt cctccttttt cagaaatgtg gtatggctta tcaaaaagaa cagtgcatac
 541 ccaacaataa agaggagcta caataatacc aaccaagaag atctttagt actgtggggg
 601 attcaccatc ctaatgatgc ggcagagcag acaaagctct atcaaaaccc aaccacttac
 661 atttccgttg aacatcaac actgaaccag agattggttc cagaaatagc tactagaccc
 721 aaagtaaacg ggcaaagtgg aagaatggag ttcttctgga caattttaaa gccgaatgat
 781 gccatcaatt tcgagagtaa tggaaatttc attgctccag aatatgcata caaaattgtc
 841 aagaaagggg actcagcaat tatgaaaagt gaattggaat atggtaactg caacaccaag
 901 tgtcaaactc aatgggggc gataaactct agtatgccat tccacaacat acacccctc
 961 accatcgggg aatgccccaa atatgtgaaa tcaaacagat tagtccttgc gactggactc
1021 agaaatacccc tcagagaga gaagaagaa aaaagagag gactatttgg agctatagca
1081 ggttttatag agggaggatg gcagggaatg gtagatggtt ggtatgggta ccaccatagc
1141 aatgagcagg ggagtggata cgctgcagac aaagaatcca ctcaaaaggc aatagatgga
1201 gtcaccaata aggtcaactc gatcattgac aaaatgaaca ctcagtttga ggccgttgga
1261 agggaattta ataacttgga aaggaggata gagaatttaa acaagcagat ggaagacgga
1321 ttcctagatg tctggactta taatgctgaa cttctggttc tcatggaaaa tgagagaact
1381 ctagactttc atgactcaaa tgtcaagaac ctttatgaca aggtccgact acagcttagg
1441 gataatgcaa aggagctggg taatggttgt ttcgagttct atcacaaatg tgataatgaa
1501 tgtatggaaa gtgtaaaaaa cggaacgtat gactaccgc agtattcaga agaagcaaga
1561 ctaaacagag aggaaataag tggagtaaaa ttggaatcaa tgggaactta ccaaatactg
1621 tcaatttatt caacagtggc gagttcccta gcactggcaa tcatggtagc tggtctatct
1681 ttatggatgt gctccaatgg atcgttacaa tgcagaattt gcatttaaat ttgtgagttc
1741 agattgtagt taaaaacacc
```

FIG. 96

Influenza Virus HA Representative H7 HA (Type 1 protein)

ACVLVEAKGDKICLGHHAVVNGTKVNTLTEKGIEVVNATETVET

ANIGKICTQGKRPTDLGQCGLLGTLIGPPQCDQFLEFESDLIIERREGNDVCYPGKFT

NEESLRQILRGSGGIDKESMGFTYSGIITNGATSACRRSGSSFYAEMKWLLSNSDNAA

FPQMTKSYRNPRNKPALIVWGIHHSGSTTEQTKLYGSGNKLITVESSKYQQSFTPSPG

ARPQVNGESGRIDFHWMLLDPNDTVTFTFNGAFIAPDRASFFKGESLGVQSDVPLDSS

CGGDCFHSGGTIVSSLPFQNINPRTVGKCPRYVKQPSLLLATGMRNVPENPKTRGLFG

AIAGFIEKDGGSHYG

FIG. 97

Influenza Virus HA Representative H7 HA (Type 1 protein)

```
   1 ttgcttgtgt gctggttgaa gctaagggag acaaaatatg ccttgggcac catgctgtgg
  61 taaatgggac aaaggtgaac acgctaacag agaaggggat tgaagtagtg aatgctacgg
 121 agacggtaga aactgcgaat atcgggaaaa tctgcaccca agggaaaagg ccaaccgacc
 181 tgggacaatg tggactccta ggaaccctaa taggacctcc ccaatgtgat cagttcctgg
 241 agtttgaatc tgatttaata attgagcgaa gagaaggaaa tgatgtgtgc tatcctggga
 301 aattcacaaa tgaggaatca ctaaggcaga tccttcgagg gtcaggagga atcgataaag
 361 agtcgatggg tttcacatat agtggaataa taaccaatgg agcaacaagt gcttgcagaa
 421 gatcaggttc ttccttctat gcggagatga gtggttgct gtcaaattct gacaatgcag
 481 cattccccca aatgaccaaa tcatatagaa atcccagaaa caaaccagcc ctaatagttt
 541 ggggaattca tcattctgga tcgactactg agcagaccaa actctatgga agtggaaaca
 601 agttgataac tgtagaaagc tcgaaatatc agcaatcgtt cacccccgagt ccgggagcac
 661 ggccacaagt aaatggagag tctgggagaa tcgatttcca ttggatgctt cttgatccca
 721 acgacacagt gactttcacc ttcaatgggg cattcatagc ccctgacaga gcaagtttct
 781 tcaaggaga atcactagga gtccagagtg atgttccctt agactctagt tgtggagggg
 841 attgctttca cagtggaggt acaatagtca gttctctgcc attccaaaac attaaccccta
 901 gaacagtggg aaaatgcccc cgatatgtca aacagccaag cctccttttg gctactggaa
 961 tgaggaatgt cccagagaat ccaaagacca gaggactttt tggagcaatt gccggattca
1021 tagagaagga tggagggtct cattacggg
```

FIG. 98

Influenza Virus HA Representative H9 HA (Type 1 protein)

METISLITILLVVTASNADKICIGHQSTNSTETVDTLTETNVPV

THAKELLHTEHNGMLCATSLGHPLILDTCTIEGLVYGNPSCDLLLGGREWSYIVERSS

AVNGTCYPGNVENLEELRTLFSSASSYQRIQIFPDTTWNVTYTGTSRACSGSFYRSMR

WLTQKSGFYPVQDAQYTNNRGKSILFVWGIHHPPTYTEQTNLYIRNDTTTSVTTEDLN

RTFKPVIGPRPLVNGLQGRIDYYWSVLKPGQTLRVRSNGNLIAPWYGHVLSGGSHGRI

LKTDLKGGNCVVQCQTEKGGLNSTLPFHNISKYAFGTCPKYVRVNSLKLAVGLRNVPA

RSSRGLFGAIAGFIEGGWPGLVAGWYGFQHSNDQGVGMAADRDSTQKAIDKITSKVNN

IVDKMNKQYEIIDHEFSEVETRLNMINNKIDDQIQDVWAYNAELLVLLENQKTLDEHD

ANVNNLYNKVKRALGSNAMEDGKGCFELYHKCDDQCMETIRNGTYNRRKYREESRLER

QKIEGVKLESEGTYKILTIYSTVASSLVLAMGFAAFLFWAMSNGSCRCNICI

FIG. 99

Influenza Virus HA Representative H9 HA (Type 1 protein)

```
   1 gcaaaagcag gggaattact taactagcaa aatggaaaca atatcactaa taactatact
  61 actagtagta acagcaagca atgcagataa aatctgcatc ggccaccagt caacaaactc
 121 cacagaaact gtggacacgc taacagaaac caatgttcct gtgacacatg ccaaagaatt
 181 gctccacaca gagcataatg gaatgctgtg tgcaacaagc ctgggacatc ccctcattct
 241 agacacatgc actattgaag gactagtcta tggcaaccct tcttgtgacc tgctgttggg
 301 aggaagagaa tggtcctaca tcgtcgaaag atcatcagct gtaaatggaa cgtgttaccc
 361 tgggaatgta gaaaacctag aggaactcag gacactttt agttccgcta gttcctacca
 421 aagaatccaa atcttcccag acacaacctg gaatgtgact tacactggaa caagcagagc
 481 atgttcaggt tcattctaca ggagtatgag atggctgact caaaagagcg gttttttaccc
 541 tgttcaagac gcccaataca caaataacag gggaaagagc attctttcg tgtggggcat
 601 acatcaccca cccacctata ccgagcaaac aaatttgtac ataagaaacg acacaacaac
 661 aagcgtgaca acagaagatt tgaataggac cttcaaacca gtgatagggc caaggcccct
 721 tgtcaatggt ctgcaggaa gaattgatta ttattggtcg gtactaaaac caggccaaac
 781 attgcgagta cgatccaatg gaatctaat tgctccatgg tatggacacg ttctttcagg
 841 agggagccat ggaagaatcc tgaagactga tttaaaaggt ggtaattgtg tagtgcaatg
 901 tcagactgaa aaaggtggct taaacagtac attgccattc cacaatatca gtaaatatgc
 961 atttggaacc tgccccaaat atgtaagagt aatagtctc aaactggcag tcggtctgag
1021 gaacgtgcct gctagatcaa gtagaggact atttggagcc atagctggat tcatagaagg
1081 aggttggcca ggactagtcg ctggctggta tggtttccag cattcaaatg atcaagggt
1141 tggtatggct gcagataggg attcaactca aaaggcaatt gataaaataa catccaaggt
1201 gaataatata gtcgacaaga tgaacaagca atatgaaata attgatcatg aattcagtga
1261 ggttgaaact agactcaata tgatcaataa taagattgat gaccaaatac aagacgtatg
1321 ggcatataat gcagaattgc tagtactact tgaaaatcaa aaaacactcg atgagcatga
1381 tgcgaacgtg aacaatctat ataacaaggt gaagagggca ctgggctcca atgctatgga
1441 agatgggaaa ggctgtttcg agctataccc taaatgtgat gatcagtgca tggaaacaat
1501 tcggaacggg acctataata ggagaaagta tagagaggaa tcaagactag aaaggcagaa
1561 aatagagggg gttaagctgg aatctgaggg aacttacaaa atcctcacca tttattcgac
1621 tgtcgcctca tctcttgtgc ttgcaatggg gtttgctgcc ttcctgttct gggccatgtc
1681 caatggatct tgcagatgca acatttgtat ataa
```

FIG. 100

Nipah Virus F Protein (Type 1 protein)

MVVILDKRCYCNLLILILMISECSVGILHYEKLSKIGLVKGVTR

KYKIKSNPLTKDIVIKMIPNVSNMSQCTGSVMENYKTRLNGILTPIKGALEIYKNNTH

DLVGDVRLAGVIMAGVAIGIATAAQITAGVALYEAMKNADNINKLKSSIESTNEAVVK

LQETAEKTVYVLTALQDYINTNLVPTIDKISCKQTELSLDLALSKYLSDLLFVFGPNL

QDPVSNSMTIQAISQAFGGNYETLLRTLGYATEDFDDLLESDSITGQIIYVDLSSYYI

IVRVYFPILTEIQQAYIQELLPVSFNNDNSEWISIVPNFILVRNTLISNIEIGFCLIT

KRSVICNQDYATPMTNNMRECLTGSTEKCPRELVVSSHVPRFALSNGVLFANCISVTC

QCQTTGRAISQSGEQTLLMIDNTTCPTAVLGNVIISLGKYLGSVNYNSEGIAIGPPVF

TDKVDISSQISSMNQSLQQSKDYIKEAQRLLDTVNPSLISMLSMIILYVLSIASLCIG

LITFISFIIVEKKRNTYSRLEDRRVRPTSSGDLYYIGT

FIG. 101

Nipah Virus  F Protein   (Type 1 protein)

```
                                                                        atggtag
     6661 ttatacttga caagagatgt tattgtaatc ttttaatatt gattttgatg atctcggagt
     6721 gtagtgttgg gattctacat tatgagaaat tgagtaaaat tggacttgtc aaaggagtaa
     6781 caagaaaata caagattaaa agcaatcctc tcacaaaaga cattgttata aaaatgattc
     6841 cgaatgtgtc gaacatgtct cagtgcacag ggagtgtcat ggaaaattat aaaacacgat
     6901 taaacggtat cttaacacct ataaagggag cgttagagat ctacaaaaac aacactcatg
     6961 accttgtcgg tgatgtgaga ttagccggag ttataatggc aggagttgct attgggattg
     7021 caaccgcagc tcaaatcact gcaggtgtag cactatatga ggcaatgaag aatgctgaca
     7081 acatcaacaa actcaaaagc agcattgaat caactaatga agctgtcgtt aaacttcaag
     7141 agactgcaga aaagacagtc tatgtgctga ctgctctaca ggattacatt aatactaatt
     7201 tagtaccgac aattgacaag ataagctgca acagacaga actctcacta gatctggcat
     7261 tatcaaagta cctctctgat ttgctttttg tatttggccc caaccttcaa gacccagttt
     7321 ctaattcaat gactatacag gctatatctc aggcattcgg tggaaattat gaaacactgc
     7381 taagaacatt gggttacgct acagaagact ttgatgatct tctagaaagt gacagcataa
     7441 caggtcaaat catctatgtt gatctaagta gctactatat aattgtcagg gtttattttc
     7501 ctattctgac tgaaattcaa caggcctata tccaagagtt gttaccagtg agcttcaaca
     7561 atgataattc agaatggatc agtattgtcc caaatttcat attggtaagg aatacattaa
     7621 tatcaaatat agagattgga ttttgcctaa ttacaaagag gagcgtgatc tgcaaccaag
     7681 attatgccac acctatgacc aacaacatga gagaatgttt aacgggatcg actgagaagt
     7741 gtcctcgaga gctggttgtt tcatcacatg ttcccagatt tgcactatct aacggggttc
     7801 tgtttgccaa ttgcataagt gttacatgtc agtgtcaaac aacaggcagg caatctcac
     7861 aatcaggaga acaaactctg ctgatgattg acaacaccac ctgtcctaca gccgtactcg
     7921 gtaatgtgat tatcagctta gggaaatatc tggggtcagt aaattataat tctgaaggca
     7981 ttgctatcgg tcctccagtc tttacagata agttgatat atcaagtcag atatccagca
     8041 tgaatcagtc cttacaacag tctaaggact atatcaaaga ggctcaacga ctccttgata
     8101 ctgttaatcc atcattaata agcatgttgt ctatgatcat actgtatgta ttatcgatcg
     8161 catcgttgtg tataggttg attacattta tcagttttat cattgttgag aaaaagagaa
     8221 acacctacag cagattagag gataggagag tcagacctac aagcagtggg gatctctact
     8281 acattgggac atagtgtatt
```

FIG. 102

Respiratory Syncytial Virus F Protein (first example) (Type 1 protein)

MELLIHRLSAIFLTLAINALYLTSSQNITEEFYQSTCSAVSRGY

FSALRTGWYTSVITIELSNIKETKCNGTDTKVKLIKQELDKYKNAVTELQLLMQNTPA

ANNRARREAPQYMNYTINTTKNLNVSISKKRKRRFLGFLLGVGSAIASGIAVSKVLHL

EGEVNKIKNALLSTNKAVVSLSNGVSVLTSKVLDLKNYINNQLLPIVNQQSCRISNIE

TVIEFQQKNSRLLEINREFSVNAGVTTPLSTYMLTNSELLSLINDMPITNDQKKLMSS

NVQIVRQQSYSIMSIIKEEVLAYVVQLPIYGVIDTPCWKLHTSPLCTTNIKEGSNICL

TRTDRGWYCDNAGSVSFFPQADTCKVQSNRVFCDTMNSLTLPSEVSLCNTDIFNSKYD

CKIMTSKTDISSSVITSLGAIVSCYGKTKCTASNKNRGIIKTFSNGCDYVSNKGVDTV

SVGNTLYYVNKLEGKNLYVKGEPIINYYDPLVFPSDEFDASISQVNEKINQSLAFIRR

SDELLHNVNTGKSTTNIMITTIIIVIIVVLLSLIAIGLLLYCKAKNTPVTLSKDQLSG

INNIAFSK

FIG. 103

Respiratory Syncytial Virus F Protein (first example) (Type 1 protein)

```
                                    atgga gctgctgatc cacaggttaa gtgcaatctt
5701 cctaactctt gctattaatg cattgtacct cacctcaagt cagaacataa ctgaggagtt
5761 ttaccaatcg acatgtagtg cagttagcag aggttatttt agtgctttaa gaacaggttg
5821 gtataccagt gtcataacaa tagaattaag taatataaaa gaaaccaaat gcaatggaac
5881 tgacactaaa gtaaaactta taaaacaaga attagataag tataagaatg cagtgacaga
5941 attacagcta cttatgcaaa acacaccagc tgccaacaac cgggccagaa gagaagcacc
6001 acagtatatg aactatacaa tcaataccac taaaaaccta aatgtatcaa taagcaagaa
6061 gaggaaacga agatttctgg gcttcttgtt aggtgtagga tctgcaatag caagtggtat
6121 agctgtatcc aaagttctac accttgaagg agaagtgaac aagatcaaaa atgctttgtt
6181 atctacaaac aaagctgtag tcagtctatc aaatgggggtc agtgttttaa ccagcaaagt
6241 gttagatctc aagaattaca taaataacca attattaccc atagtaaatc aacagagctg
6301 tcgcatctcc aacattgaaa cagttataga attccagcag aagaacagca gattgttgga
6361 aatcaacaga gaattcagtg tcaatgcagg tgtaacaaca cctttaagca cttacatgtt
6421 aacaaacagt gagttactat cattgatcaa tgatatgcct ataacaaatg atcagaaaaa
6481 attaatgtca agcaatgttc agatagtaag gcaacaaagt tattctatca tgtctataat
6541 aaaggaagaa gtccttgcat atgttgtaca gctacctatc tatggtgtaa tagatacacc
6601 ttgctggaaa ttacacacat cacctctatg caccaccaac atcaaagaag gatcaaatat
6661 ttgtttaaca aggactgata gaggatggta ttgtgataat gcaggatcag tatccttctt
6721 tccacaggct gacacttgta aagtacagtc caatcgagta ttttgtgaca ctatgaacag
6781 tttgacatta ccaagtgaag tcagcctttg taacactgac atattcaatt ccaagtatga
6841 ctgcaaaatt atgacatcaa aaacagacat aagcagctca gtaattactt ctcttggagc
6901 tatagtgtca tgctatggta aaactaaatg cactgcatcc aacaaaaatc gtgggattat
6961 aaagacatttt tctaatggtt gtgactatgt gtcaaacaaa ggagtagata ctgtgtcagt
7021 gggcaacact ttatactatg taaacaagct ggaaggcaag aacctttatg taaaggggga
7081 acctataata aattactatg accctctagt gtttccttct gatgagtttg atgcatcaat
7141 atctcaagtc aatgaaaaaa tcaatcaaag tttagctttt attcgtagat ctgatgaatt
7201 actacataat gtaaatactg gcaaatctac tacaaatatt atgataacta caattattat
7261 agtaatcatt gtagtattgt tatcattaat agctattggt ttgctgttgt attgcaaagc
7321 caaaaacaca ccagttacac taagcaaaga ccaactaagt ggaatcaata atattgcatt
7381 cagcaaatag
```

FIG. 104

Respiratory Syncytial Virus F Protein (second example)(Type 1 protein)

```
mellilkana ittiltavtf cfasgqnite efyqstcsav skgylsalrt gwytsvitie
lsnikenkcn gtdakvklik qeldkyknav telqllmqst patnnrarre lprfmnytln
nakktnvtls kkrkrrflgf llgvgsaias gvavskvlhl egevnkiksa llstnkavvs
lsngvsvlts kvldlknyid kqllpivnkq scsisniatv iefqqknnrl leitrefsvn
agvttpvsty mltnsellsl indmpitndq kklmsnnvqi vrqqsysims iikeevlayv
vqlplygvid tpcwklhtsp lcttntkegs nicltrtdrg wycdnagsvs ffpqaetckv
qsnrvfcdtm nsltlpsevn lcnvdifnpk ydckimtskt dvsssvitsl gaivscygkt
kctasnknrg iiktfsngcd yvsnkgvdtv svgntlyyvn kqegkslyvk gepiinfydp
lvfpsdefda sisqvnekin qslafirksd ellhnvnagk stinimitti iiviivills
liavglllyc karstpvtls kdqlsginni afsn
```

FIG. 105

SARS Virus Surface Spike Glycoprotein (Type 1 protein)

MFIFLLFLTLTSGSDLDRCTTFDDVQAPNYTQHTSSMRGVYYPD

EIFRSDTLYLTQDLFLPFYSNVTGFHTINHTFGNPVIPFKDGIYFAATEKSNVVRGWV

FGSTMNNKSQSVIIINNSTNVVIRACNFELCDNPFFAVSKPMGTQTHTMIFDNAFNCT

FEYISDAFSLDVSEKSGNFKHLREFVFKNKDGFLYVYKGYQPIDVVRDLPSGFNTLKP

IFKLPLGINITNFRAILTAFSPAQDIWGTSAAAYFVGYLKPTTFMLKYDENGTITDAV

DCSQNPLAELKCSVKSFEIDKGIYQTSNFRVVPSGDVVRFPNITNLCPFGEVFNATKF

PSVYAWERKKISNCVADYSVLYNSTFFSTFKCYGVSATKLNDLCFSNVYADSFVVKGD

DVRQIAPGQTGVIADYNYKLPDDFMGCVLAWNTRNIDATSTGNYNYKYRYLRHGKLRP

FERDISNVPFSPDGKPCTPPALNCYWPLNDYGFYTTTGIGYQPYRVVVLSFELLNAPA

TVCGPKLSTDLIKNQCVNFNFNGLTGTGVLTPSSKRFQPFQQFGRDVSDFTDSVRDPK

TSEILDISPCSFGGVSVITPGTNASSEVAVLYQDVNCTDVSTAIHADQLTPAWRIYST

GNNVFQTQAGCLIGAEHVDTSYECDIPIGAGICASYHTVSLLRSTSQKSIVAYTMSLG

ADSSIAYSNNTIAIPTNFSISITTEVMPVSMAKTSVDCNMYICGDSTECANLLLQYGS

FCTQLNRALSGIAAEQDRNTREVFAQVKQMYKTPTLKYFGGFNFSQILPDPLKPTKRS

FIEDLLFNKVTLADAGFMKQYGECLGDINARDLICAQKFNGLTVLPPLLTDDMIAAYT

AALVSGTATAGWTFGAGAALQIPFAMQMAYRFNGIGVTQNVLYENQKQIANQFNKAIS

QIQESLTTTSTALGKLQDVVNQNAQALNTLVKQLSSNFGAISSVLNDILSRLDKVEAE

VQIDRLITGRLQSLQTYVTQQLIRAAEIRASANLAATKMSECVLGQSKRVDFCGKGYH

LMSFPQAAPHGVVFLHVTYVPSQERNFTTAPAICHEGKAYFPREGVFVFNGTSWFITQ

RNFFSPQIITTDNTFVSGNCDVVIGIINNTVYDPLQPELDSFKEELDKYFKNHTSPDV

DLGDISGINASVVNIQKEIDRLNEVAKNLNESLIDLQELGKYEQYIKWPWYVWLGFIA

GLIAIVMVTILLCCMTSCCSCLKGACSCGSCCKFDEDDSEPVLKGVKLHYT

FIG. 106

SARS Virus Surface Spike Glycoprotein (Type 1 protein)

```
                catgtttatt ttcttattat ttcttactct cactagtggt agtgaccttg
21541 accggtgcac cacttttgat gatgttcaag ctcctaatta cactcaacat acttcatcta
21601 tgagggggt  ttactatcct gatgaaattt ttagatcaga cactctttat ttaactcagg
21661 atttatttct tccatttat  tctaatgtta cagggtttca tactattaat catacgttg
21721 gcaaccctgt catacctttt aaggatggta tttattttgc tgccacagag aaatcaaatg
21781 ttgtccgtgg ttgggttttt ggttctacca tgaacaacaa gtcacagtcg gtgattatta
21841 ttaacaattc tactaatgtt gttatacgag catgtaactt tgaattgtgt gacaaccctt
21901 tctttgctgt ttctaaaccc atgggtacac agacacatac tatgatattc gataatgcat
21961 ttaattgcac tttcgagtac atatctgatg cctttcgct  tgatgtttca gaaaagtcag
22021 gtaattttaa acacttacga gagtttgtgt ttaaaaataa agatgggttt ctctatgttt
22081 ataagggcta tcaacctata gatgtagttc gtgatctacc ttctggtttt aacactttga
22141 aacctatttt taagttgcct cttggtatta acattacaaa ttttagagcc attcttacag
22201 ccttttcacc tgctcaagac atttgggca  cgtcagctgc agcctatttt gttggctatt
22261 taaagccaac tacatttatg ctcaagtatg atgaaaatgg tacaatcaca gatgctgttg
22321 attgttctca aaatccactt gctgaactca aatgctctgt taagagcttt gagattgaca
22381 aaggaattta ccagacctct aatttcaggg ttgttccctc aggagatgtt gtgagattcc
22441 ctaatattac aaacttgtgt ccttttggag aggttttaa  tgctactaaa ttcccttctg
22501 tctatgcatg ggagagaaaa aaaatttcta attgtgttgc tgattactct gtgctctaca
22561 actcaacatt ttttcaacc  tttaagtgct atggcgtttc tgccactaag ttgaatgatc
22621 tttgcttctc caatgtctat gcagattctt ttgtagtcaa gggagatgat gtaagacaaa
22681 tagcgccagg acaaactggt gttattgctg attataatta taaattgcca gatgatttca
22741 tgggttgtgt ccttgcttgg aatactagga acattgatgc tacttcaact ggtaattata
22801 attataaata taggtatctt agacatggca agcttaggcc ctttgagaga gacatatcta
22861 atgtgccttt ctcccctgat ggcaaacctt gcaccccacc tgctcttaat tgttattggc
22921 cattaaatga ttatggtttt tacaccacta ctggcattgg ctaccaacct acagagttg
22981 tagtactttc ttttgaactt taaatgcac  cggccacggt tgtggacca  aaattatcca
23041 ctgaccttat taagaaccag tgtgtcaatt taattttaa  tggactcact ggtactggtg
23101 tgttaactcc ttcttcaaag agatttcaac catttcaaca atttggccgt gatgtttctg
23161 atttcactga ttccgttcga gatcctaaaa catctgaaat attagacatt tcaccttgct
23221 cttttgggg  tgtaagtgta attacacctg aacaaatgc  ttcatctgaa gttgctgttc
23281 tatatcaaga tgttaactgc actgatgttt ctacagcaat tcatgcagat caactcacac
23341 cagcttggcg catatattct actggaaaca atgtattcca gactcaagca ggctgtctta
23401 taggagctga gcatgtcgac acttcttatg agtgcgacat tccattgga  gctggcattt
23461 gtgctagtta ccatacagtt tctttattac gtagtactag ccaaaaatct attgtggctt
23521 atactatgtc tttaggtgct gatagttcaa ttgcttactc taataacacc attgctatac
23581 ctactaactt ttcaattagc attactacag aagtaatgcc tgtttctatg ctaaaacct
23641 ccgtagattg taatgtctac atctgcggag attctactga atgtctaat  ttgcttctcc
23701 aatatggtag cttttgcaca caactaaatc gtgcactctc aggtattgct gctgaacagg
23761 atcgcaacac acgtgaagtg ttcgctcaag tcaaacaaat gtacaaaacc ccaactttga
23821 aatattttgg tggttttaat tttcacaaa  tattacctga ccctctaaag ccaactaaga
23881 ggtctttat  tgaggacttg ctctttaata aggtgacact cgctgatgct ggcttcatga
23941 agcaatatgg cgaatgccta ggtgatatta tgctagaga  tctcatttgt gcgcagaagt
24001 tcaatggact tacagtgttg ccacctctgc tcactgatga tatgattgct gcctacactg
24061 ctgctctagt tagtggtact gccactgctg atggacatt  tggtctggc  gctgctcttc
24121 aaatacctt  tgctatgcaa atggcatata ggttcaatgg cattggagtt acccaaaatg
24181 ttctctatga gaaccaaaaa caaatcgcca accaattaa  caaggcgatt agtcaaattc
24241 aagaatcact tacaacaaca tcaactgcat tgggcaagct gcaagacgtt gttaaccaga
24301 atgctcaagc attaaacaca cttgttaaac aacttagctc taattttggt gcaatttcaa
24361 gtgtgctaaa tgatatcctt tcgcgacttg ataaagtcga ggcggaggta caaattgaca
24421 ggttaattac aggcagactt caaagccttc aaacctatgt aacacaacaa ctaatcaggg
24481 ctgctgaaat cagggcttct gctaatcttg ctgctactaa aatgtctgag tgtgttcttg
24541 gacaatcaaa aagagttgac ttttgtggaa agggctacca ccttatgtcc ttcccacaag
```

FIG. 107-A

```
24601  cagccccgca  tggtgttgtc  ttcctacatg  tcacgtatgt  gccatcccag  gagaggaact
24661  tcaccacagc  gccagcaatt  tgtcatgaag  gcaaagcata  cttccctcgt  gaaggtgttt
24721  ttgtgtttaa  tggcacttct  tggtttatta  cacagaggaa  cttcttttct  ccacaaataa
24781  ttactacaga  caatacattt  gtctcaggaa  attgtgatgt  cgttattggc  atcattaaca
24841  acacagttta  tgatcctctg  caacctgagc  tcgactcatt  caaagaagag  ctggacaagt
24901  acttcaaaaa  tcatacatca  ccagatgttg  atcttggcga  catttcaggc  attaacgctt
24961  ctgtcgtcaa  cattcaaaaa  gaaattgacc  gcctcaatga  ggtcgctaaa  aatttaaatg
25021  aatcactcat  tgaccttcaa  gaattgggaa  aatatgagca  atatattaaa  tggccttggt
25081  atgtttggct  cggcttcatt  gctggactaa  ttgccatcgt  catggttaca  atcttgcttt
25141  gttgcatgac  tagttgttgc  agttgcctca  agggtgcatg  ctcttgtggt  tcttgctgca
25201  agtttgatga  ggatgactct  gagccagttc  tcaagggtgt  caaattacat  tacacataaa
```

FIG. 107-B

Varicella Zoster Virus gB Glycoprotein (Type 1 protein)

```
mfvtavvsvs pssfyeslqv eptqseditr sahlgdgdei reaihksqda etkptfyvc\ pptgstivrl eptrtcpdyh lgknftegia vvykeniaay kfkatvyykd vivstawags sytqitnrya drvpipvsei tdtidkfgkc sskatyvrnn hkveafnedk npqdmplias kynsvgskaw httndtymva gtpgtyrtgt svnciieeve arsifpydsf glstgdiiym spffglrdga yrehsnyamd rfhqfegyrq rdldtralle paarnflvtp hltvgwnwkp krtevcslvk wrevedvvrd eyahnfrftm ktlsttfise tnefnlnqih lsqcvkeear aiinriyttr ynsshvrtgd iqtylarggf vvvfqpllsn slarlylqel vrentnhspq khptrntrsr rsvpvelran rtitttssve famlqftydh iqehvnemla rissswcqlq nreralwsgl fpinpsalas tildqrvkar ilgdvisvsn cpelgsdtri ilqnsmrvsg sttrcysrpl isivslngsg tvegqlgtdn elimsrdlle pcvanhkryf lfghhyvyye dyryvreiav hdvgmistyv dlnltllkdr efmplqvytr delrdtglld yseiqrrnqm hslrfydidk vvqydsgtai mqgmaqffqg lgtagqavgh vvlgatgall stvhgfttfl snpfgalavg llvlaglvaa ffayryvlkl ktspmkalyp lttkglkqlp egmdpfaekp natdtpieei gdsqntepsv nsgfdpdkfr eaqemikymt lvsaaerqes karkknktsa lltsrltgla lrnrrgysrv rtenvtgv
```

FIG. 108

Varicella Zoster Virus gB Glycoprotein (Type 1 protein)

```
             tattattcaa agtggagaaa cagggatcga ccagaatacc gtcgtaatct
56821 acgattcaga cgttttttct cttctataca ccctaatgca gcggctggct ccggattcaa
56881 cggacccggc gttttcataa cctccgttac gggggtgtgg ttatgctttt tatgcatatt
56941 ttctatgttt gttacggcgg ttgtgtcggt ctctccaagc tcgttttatg agagtttaca
57001 agtagagccc acacaatcag aagatataac ccggtctgct catctgggcg atggtgatga
57061 aatcagagaa gctatacaca agtcccagga cgccgaaaca aaacccacgt tttacgtctg
57121 cccaccgcca acaggctcca caatcgtacg attagaacca actcggacat gtccggatta
57181 tcaccttggt aaaaacttta cagagggtat tgctgttgtt tataaagaaa acattgcagc
57241 gtacaagttt aaggcgacgg tatattacaa agatgttatc gttagcacgg cgtgggccgg
57301 aagttcttat acgcaaatta ctaatagata tgcggatagg gtaccaattc ccgtttcaga
57361 gatcacggac accattgata agtttggcaa gtgttcttct aaagcaacgt acgtacgaaa
57421 taaccacaaa gttgaagcct taatgagga taaaaatcca caggatatgc ctctaatcgc
57481 atcaaaatat aattctgtgg gatccaaagc atggcatact accaatgaca cgtacatggt
57541 tgccggaacc cccggaacat ataggacggg cacgtcggtg aattgcatca ttgaggaagt
57601 tgaagccaga tcaatattcc cttatgatag ttttggactt tccacgggag atataatata
57661 catgtccccg ttttttggcc tacgggatgg tgcatacaga gaacattcca attatgcaat
57721 ggatcgtttt caccagtttg aggggttatag acaaagggat cttgacacta gagcattact
57781 ggaacctgca gcgcggaact ttttagtcac gcctcattta acggttggtt ggaactggaa
57841 gccaaaacga acggaagttt gttcgcttgt caagtggcgt gaggttgaag acgtagttcg
57901 cgatgagtat gcacacaatt ttcgctttac aatgaaaaca ctttctacca cgtttataag
57961 tgaaacaaac gagtttaatc ttaaccaaat ccatctcagt caatgtgtaa aggaggaagc
58021 ccgggctatt attaaccgga tctatacaac cagatacaac tcatctcatg ttagaaccgg
58081 ggatatccag acctaccttg ccagaggggg gtttgttgtg gtgtttcaac ccctgctgag
58141 caattccctc gcccgtctct atctccaaga attggtccgt gaaaacacta atcattcacc
58201 acaaaaacac ccgactcgaa ataccagatc ccgacgaagc gtgccagttg agttgcgtgc
58261 caatagaaca ataacaacca cctcatcggt ggaatttgct atgctccagt ttacatatga
58321 ccacattcaa gagcatgtta atgaaatgtt ggcacgtatc tcctcgtcgt ggtgccagct
58381 acaaaatcgc gaacgcgccc tttggagcgg actatttcca attaacccaa gtgctttagc
58441 gagcaccatt ttggatcaac gtgttaaagc tcgtattctc ggcgacgtta tctccgtttc
58501 taattgtcca gaactggat cagatacacg cattatactt caaaactcta tgagggtatc
58561 tggtagtact acgcgttgtt atagccgtcc tttaatttca atagttagtt taaatgggtc
58621 cgggacggtg gagggccagc ttggaacaga taacgagtta attatgtcca gagatctgtt
58681 agaaccatgc gtggctaatc acaagcgata ttttctattt gggcatcact acgtatatta
58741 tgaggattat cgttacgtcc gtgaaatcgc agtccatgat gtgggaatga ttagcactta
58801 cgtagattta aacttaacac ttcttaaaga tagagagttt atgccgctgc aagtatatac
58861 aagagacgag ctgcgggata caggattact agactacagt gaaattcaac gccgaaatca
58921 aatgcattcg ctgcgttttt atgacataga caaggttgtg caatatgata gcggaacggc
58981 cattatgcag ggcatggctc agttttccca gggacttggg accgcgggcc aggccgttgg
59041 acatgtggtt cttggggcca cgggagcgct gctttccacc gtacacggat ttaccacgtt
59101 tttatctaac ccatttgggg cattggccgt gggattattg gttttggcgg gactggtagc
59161 ggcctttttt gcgtaccggt acgtgcttaa acttaaaaca gcccgatga aggcattata
59221 tccactcaca accaagggt taaaacagtt accggaagga atggatccct ttgccgagaa
59281 acccaacgct actgatccc caatagaaga aattggcgac tcacaaaaca ctgaaccgtc
59341 ggtaaatagc gggtttgatc ccgataaatt tcgagaagcc caggaaatga ttaaatatat
59401 gacgttagta tctgcggctg agcgccaaga atctaaagcc cgcaaaaaaa ataagactag
59461 cgccttttta acttcacgtc ttaccggcct tgctttacga aatcgccgag gatactcccg
59521 tgttcgcacc gagaatgtaa cggggggtgta aata
```

FIG. 109

Varicella Zoster Virus gE Glycoprotein (Type 1 protein)

MFYEALKAELVYTRAVHGFRPRANCVVLSDYIPRVACNMGTVNK

PVVGVLMGFGIITGTLRITNPVRASVLRYDDFHTDEDKLDTNSVYEPYYHSDHAESSW

VNRGESSRKAYDHNSPYIWPRNDYDGFLENAHEHHGVYNQGRGIDSGERLMQPTQMSA

QEDLGDDTGIHVIPTLNGDDRHKIVNVDQRQYGDVFKGDLNPKPQGQRLIEVSVEENH

PFTLRAPIQRIYGVRYTETWSFLPSLTCTGDAAPAIQHICLKHTTCFQDVVVDVDCAE

NTKEDQLAEISYRFQGKKEADQPWIVVNTSTLFDELELDPPEIEPGVLKVLRTEKQYL

GVYIWNMRGSDGTSTYATFLVTWKGDEKTRNPTPAVTPQPRGAEFHMWNYHSHVFSVG

DTFSLAMHLQYKIHEAPFDLLLEWLYVPIDPTCQPMRLYSTCLYHPNAPQCLSHMNSG

CTFTSPHLAQRVASTVYQNCEHADNYTAYCLGISHMEPSFGLILHDGGTTLKFVDTPE

SLSGLYVFVVYFNGHVEAVAYTVVSTVDHFVNAIEERGFPPTAGQPPATTKPKEITPV

NPGTSPLLRYAAWTGGLAAVVLLCLVIFLICTAKRMRVKAYRVDKSPYNQSMYYAGLP

VDDFEDSESTDTEEEFGNAIGGSHGGSSYTVYIDKTR

FIG. 110

Varicella Zoster Virus gE Glycoprotein (Type 1 protein)

```
           gcggggatgt tttatgaagc cttaaaggcc gagctggtat acacgagagc agtccatggt
    115681 tttagacctc gggcgaattg cgtggtttta agtgactata ttccgagggt cgcctgtaat
    115741 atggggacag ttaataaacc tgtggtgggg gtattgatgg ggttcggaat tatcacggga
    115801 acgttgcgta taacgaatcc ggtcagagca tccgtcttgc gatacgatga ttttcacacc
    115861 gatgaagaca aactggatac aaactccgta tatgagcctt actaccattc agatcatgcg
    115921 gagtcttcat gggtaaatcg gggagagtct tcgcgaaaag cgtacgatca taactcacct
    115981 tatatatggc cacgtaatga ttatgatgga tttttagaga acgcacacga acaccatggg
    116041 gtgtataatc agggccgtgg tatcgatagc ggggaacggt taatgcaacc cacacaaatg
    116101 tctgcacagg aggatcttgg ggacgatacg ggcatccacg ttatccctac gttaaacggc
    116161 gatgacagac ataaaattgt aaatgtggac caacgtcaat acggtgacgt gtttaaagga
    116221 gatcttaatc caaaacccca aggccaaaga ctcattgagg tgtcagtgga agaaaatcac
    116281 ccgtttactt tacgcgcacc gattcagcgg atttatggag tccggtacac cgagacttgg
    116341 agcttttttgc cgtcattaac ctgtacggga gacgcagcgc ccgccatcca gcatatatgt
    116401 ttaaaacata caacatgctt tcaagacgtg gtggtggatg tggattgcgc ggaaaatact
    116461 aaagaggatc agttggccga aatcagttac cgttttcaag gtaagaagga agcggaccaa
    116521 ccgtggattg ttgtaaacac gagcacactg tttgatgaac tcgaattaga ccccccccgag
    116581 attgaaccgg gtgtcttgaa agtacttcgg acagaaaaac aatactttggg tgtgtacatt
    116641 tggaacatgc gcggctccga tggtacgtct acctacgcca cgttttttggt cacctggaaa
    116701 ggggatgaaa aaacaagaaa ccctacgccc gcagtaactc ctcaaccaag aggggctgag
    116761 tttcatatgt ggaattacca ctcgcatgta ttttcagttg gtgatacgtt tagcttggca
    116821 atgcatcttc agtataagat acatgaagcg ccatttgatt tgctgttaga gtggttgtat
    116881 gtccccatcg atcctacatg tcaaccaatg cggttatatt ctacgtgttt gtatcatccc
    116941 aacgcacccc aatgcctctc tcatatgaat tccggttgta catttacctc gccacattta
    117001 gcccagcgtg ttgcaagcac agtgtatcaa aattgtgaac atgcagataa ctacaccgca
    117061 tattgtctgg gaatatctca tatggagcct agctttggtc taatcttaca cgacggggc
    117121 accacgttaa agtttgtaga tacacccgag agtttgtcgg gattatacgt ttttgtggtg
    117181 tattttaacg ggcatgttga agccgtagca tacactgttg tatccacagt agatcatttt
    117241 gtaaacgcaa ttgaagagcg tggatttccg ccaacggccg gtcagccacc ggcgactact
    117301 aaacccaagg aaattacccc cgtaaacccc ggaacgtcac cacttctacg atatgccgca
    117361 tggaccggag ggcttgcagc agtagtactt ttatgtctcg taatatttt aatctgtacg
    117421 gctaaacgaa tgaggggttaa agcctatagg gtagacaagt ccccgtataa ccaaagcatg
    117481 tattacgctg gccttccagt ggacgatttc gaggactcgg aatctacgga tacggaagaa
    117541 gagtttggta acgcgattgg agggagtcac ggggttcga gttacacggt gtatatagat
    117601 aagacccggt gatcaccgaa
```

FIG. 111

Varicella Zoster Virus gI Glycoprotein (Type 1 protein)

```
mflihclisa vifyiqvtna lifkgdhvsl qvnssltsil ipmqndnyte ikgqlvfige qlptgtnysg tlellyadtv afcfrsvqvi rydgcprirt safiscrykh swhygnstdr istepdagvm lkitkpgind agvyvllvrl dhsrstdgfi lgvnvytags hhnihgviyt spslqngyst ralfqqarlc dlpatpkgsg tslfqhmldl ragkslednp wlhedvvtte tksvvkegie nhvyptdmst lpekslndpp enlliiipiv asvmiltamv ivivisvkrr rikkhpiyrp ntktrrgiqn atpesdvmle aaiaqlatir eespphsvvn pfvk
```

FIG. 112

Varicella Zoster Virus gI Glycoprotein (Type 1 protein)

```
                at gtttttaatc caatgtttga tatcggccgt tatattttac atacaagtga
114481 ccaacgcttt gatcttcaag ggcgaccacg tgagcttgca agttaacagc agtctcacgt
114541 ctatccttat tcccatgcaa aatgataatt atacagagat aaaaggacag cttgtcttta
114601 ttggagagca actacctacc gggacaaact atagcggaac actggaactg ttatacgcgg
114661 atacggtggc gttttgtttc cggtcagtac aagtaataag atacgacgga tgtccccgga
114721 ttagaacgag cgcttttatt tcgtgtaggt acaaacattc gtggcattat ggtaactcaa
114781 cggatcggat atcaacagag ccggatgctg gtgtaatgtt gaaaattacc aaaccgggaa
114841 taaatgatgc tggtgtgtat gtacttcttg ttcggttaga ccatagcaga tccaccgatg
114901 gtttcattct tggtgtaaat gtatatacag cgggctcgca tcacaacatt cacggggtta
114961 tctacacttc tccgtctcta cagaatggat attctacaag agccctttt caacaagctc
115021 gtttgtgtga tttacccgcg acacccaaag ggtccggtac ctccctgttt caacatatgc
115081 ttgatcttcg tgccggtaaa tcgttagagg ataacccttg gttacatgag gacgttgtta
115141 cgacagaaac taagtccgtt gttaaggagg ggatagaaaa tcacgtatat ccaacggata
115201 tgtccacgtt acccgaaaag tcccttaatg atcctccaga aaatctactt ataattattc
115261 ctatagtagc gtctgtcatg atcctcaccg ccatggttat tgttattgta ataagcgtta
115321 agcgacgtag aattaaaaaa catccaattt atcgcccaaa tacaaaaaca agaagggca
115381 tacaaaatgc gacaccagaa tccgatgtga tgttggaggc cgccattgca caactagcaa
115441 cgattcgcga agaatccccc ccacattccg ttgtaaaccc gtttgttaaa tagaactaat
```

FIG. 113

Canine Distemper Virus H Glycoprotein (Type 2 protein)

MEVKVENIRAIDMLKARVKNRVARSKCFKNASLILIGITTLSIA

LNIYLIINYTIQKTSSESEHHTSSPPTESNKEASTISTDNPDINPNSQHPTQQSTENP

TLNPAASVSPSETEPASTPDTTNRLSSVDRSTAQPSESRTKTKPTVHTRNNPSTASST

QSPPRATTKAIRRATTFRMSSTGKRPTTTSVQSDSSTTTQNHEETGSANPQASVSTMQN

FIG. 114

Avian Metapneumovirus G Protein (Type 2 protein)

MEVKVENVGKSQELKVKVKNFIKRSDCKKKLFALILGLVSFELT

MNIMLSVMYVESNEALSLCRIQGTPAPRDNKTNTENATKETTLHTTTTTRDPEVRETK

TTKPQANEGATNPSRNLTTKGDKHQTTRATTEAELEKQSKQTTEPGTSTQKHTPARPS

SKSPTTTQATAQPTTPTAPKASTAPKNRQATTKKTETDTTTASRARNTNNPTETATTT

PKATTETGKGKEGPTQHTTKEQPETTARETTTPQPRRTAGASPRAS

FIG. 115

Avian Metapneumovirus G Protein (Type 2 protein)

```
                                        a tggaggtcaa ggtagagaat gttggcaagt
6181 cacaggagct taaagttaaa gtcaagaatt ttataaaaag gtctgattgc aagaaaaaac
6241 tttttgcctt gattttaggg ctagtcagct ttgaactcac tatgaatata atgctgtctg
6301 tcatgtatgt ggagtcaaat gaggccctaa gtttatgtag gatccaaggg actcctgctc
6361 caagagataa taagacaaac acagaaaacg caacaaagga aacaacactc cacacaacga
6421 ccacaacaag ggatccagag gtgagggaaa caaaaaccac caagccccag gccaatgaag
6481 gagcaacaaa cccaagcagg aacctcacca ccaagggaga caaacaccaa acgacaagag
6541 caacaacaga ggcagaactg gaaaaacaaa gcaagcaaac cacagagcca ggcaccagca
6601 cccaaaagca cacccccgca aggccaagca gcaaatcccc caccacaaca caagcaacag
6661 cacaaccgac aacaccaaca gccccaaaag caagcacagc acccaagaac agacaggcaa
6721 caaccaaaaa aaccgaaacg gacaccacaa cagcaagcag agcaaggaac accaacaacc
6781 ccacagagac agcaacaaca accccaaag caacaacaga aacaggcaag ggcaaagagg
6841 ggccaacaca gcacacaacc aaagaacagc ccgagacaac agcacgagag acaacaaccc
6901 cacagccaag aagaacagcc ggagctagcc caagagcaag ttagttaa
```

FIG. 116

Human Metapneumovirus G Glycopotein (Type 2 protein)

MEVKVENIRAIDMLKARVKNRVARSKCFKNASLILIGITTLSIA

LNIYLIINYTIQKTSSESEHHTSSPPTESNKEASTISTDNPDINPNSQHPTQQSTENP

TLNPAASVSPSETEPASTPDTTNRLSSVDRSTAQPSESRTKTKPTVHTRNNPSTASST

QSPPRATTKAIRRATTFRMSSTGKRPTTTSVQSDSSTTTQNHEETGSANPQASVSTMQ

Human Metapneumovirus G Glycoprotein (Type 2 protein)

```
                                                                  atggaggtg
6241 aaagtagaga acattcgagc aatagacatg ctcaaagcaa gagtgaaaaa tcgtgtggca
6301 cgtagcaaat gctttaaaaa tgcttcttta atcctcatag gaataactac actgagtata
6361 gctctcaata tctatctgat cataaactac acaatacaaa aaacctcatc tgaatcagaa
6421 caccacacca gctcaccacc cacagaatcc aacaaggaag cttcaacaat ctccacagac
6481 aacccagaca tcaatccaaa ctcacagcat ccaactcaac agtccacaga aaaccccaca
6541 ctcaaccccg cagcatcagt gagcccatca gaaacagaac cagcatcaac accagacaca
6601 acaaaccgcc tgtcctccgt agacaggtcc acagcacaac caagtgaaag cagaacaaag
6661 acaaaaccga cagtccacac aagaaacaac ccaagcacag cttccagtac acaatcccca
6721 ccacgggcaa caacgaaggc aatccgcaga gccaccactt tccgcatgag cagcacagga
6781 aaaagaccaa ccacaacatc agtccagtcc gacagcagca ccacaaccca aaatcatgaa
6841 gaaacaggtt cagcgaaccc acaggcatct gtaagcacaa tgcaaaacta gcacaccaac
```

FIG. 118

Human Respiratory Sncytial Virus G Glycoprotein (Type 2 protein)

MSKHKNQRTARTLEKTWDTLNHLIVISSCLYRLNLKSIAQIALS

VLAMIISTSLIIAAIIFIISANHKVTLTTVTVQTIKNHTEKNITTYLTQVPPERVSSS

KQPTTTSPIHTNSATTSPNTKSETHHTTAQTKGRTTTSTQTNKPSTKPRLKNPPKKPK

DDYHFEVFNFVPCSICGNNQLCKSICKTIPSNKPKKKPTIKPTNKPTTKTTNKRDPKT

PAKTTKKETTTNPTKKPTLTTTERDTSTSQSTVLDTTTLEHTIQQQSLHSTTPENTPN

STQTPTASEPSTSNSTQNTQSHA

FIG. 119

Influenza Virus B NA Glycoprotein (Type 2 protein)

```
mlpstiqtlt lfltsggvll slyvsallsy llysdillkf spkiiaptts ldcanasnvq
avnhsatkem kflppepewt yprlscqgst fqkallisph rfgeakgnsa pliirepfia
cgpkeckhfa lthyaaqpgg yyngtredrn klrhlisvnl gkiptvensi fhmaawsgsa
chdgrewtyi gvdgpdsnal ikikygeayt dtyhsyanni lrtqesacnc iggdcylmit
dgsasgiskc rflkiregri ikeifptgrv ehteectcgf asnktiecac rdnsytakrp
fvklnvetdt aeirlmctet yldtprpddg sitgpcesng dkgsggvkgg fvhqrmaski
grwysrtmsk tkrmgmelyv kydgdpwtds dalapsgvmv smeepgwysf gfeikdkkcd
vpcigiemvh dggkrtwhsa ataiyclmgs gqllwdtvtg vnmal
```

FIG. 120

Influenza Virus N1 NA from H5N1 Virus (Type 2 protein)

MNPNQKIITIGSICMVIGIVSLMLQIGNMISIWVSHSIQTGNQH

QAEPISNTNFLTEKAVASVTLAGNSSLCPISGWAVHSKDNSIRIGSKGDVFVIREPFI

SCSHLECRTFFLTQGALLNDKHSNGTVKDRSPHRTLMSCPVGEAPSPYNSRFESVAWS

ASACHDGTSWLTIGISGPDNGAVAVLKYNGIITDTIKSWRNNILRTQESECACVNGSC

FTVMTDGPSNGQASYKIFKMEKGKVVKSVELDAPNYHYEECSCYPDAGEITCVCRDNW

HGSNRPWVSFNQNLEYQIGYICSGVFGDNPRPNDGTGSCGPVSPNGAYGVKGFSFKYG

NGVWIGRTKSTNSRSGFEMIWDPNGWTGTDSSFSVKQDIVAITDWSGYSGSFVQHPEL

TGLDCIRPCFWVELIRGRPKESTIWTSGSSISFCGVNSDTVGWSWPDGAELPFTIDK

FIG. 121

Influenza Virus N1 NA from H5N1 Virus (Type 2 protein)

```
   1 atgaatccaa atcagaagat aataaccatc ggatcaatct gtatggtaat tggaatagtt
  61 agcttaatgt tacaaattgg gaacatgatc tcaatatggg tcagtcattc aattcagaca
 121 gggaatcaac accaagctga accaatcagc aatactaatt ttcttactga gaaagctgtg
 181 gcttcagtaa cattagcggg caattcatct ctttgcccca ttagcggatg ggctgtacac
 241 agtaaggaca acagtataag gatcggttcc aaggggatg tgtttgttat aagagagccg
 301 ttcatctcgt gctcccactt agaatgtaga actttctttt tgactcaggg agccttgctg
 361 aatgacaagc actccaatgg gactgttaaa gacagaagcc ctcacagaac attaatgagt
 421 tgtcctgtgg gtgaggctcc ctccccatat aactcaaggt ttgagtctgt tgcttggtca
 481 gcaagtgctt gccatgatgg caccagttgg ttgacaattg gaatttcggg cccagacaat
 541 ggggctgtgg ctgtattgaa gtacaatggc ataataacag acactatcaa gagttggagg
 601 aacaacatac tgagaactca gagtctgaa tgtgcatgtg taaatggctc ttgctttact
 661 gtaatgactg atggaccaag taatgggcag gcatcatata aaatcttcaa gatggaaaaa
 721 gggaaagtgg ttaaatcagt cgaattggat gctcctaatt atcattatga ggagtgctcc
 781 tgttatcctg atgccggcga aatcacatgt gtgtgcaggg ataattggca tggctcaaat
 841 aggccatggg tatctttcaa tcaaaatttg gagtatcaaa tagggtatat atgcagtgga
 901 gttttcggag acaatccacg ccccaatgat ggaacaggta gttgtggtcc ggtgtcccct
 961 aacgggggcat atggggtaaa agggttttca tttaaatacg gcaatggtgt ttggatcggg
1021 agaaccaaaa gcactaattc caggagcggc tttgaaatga tttgggatcc aaatgggtgg
1081 actggaacag acagtagctt ttcggtgaaa caagatatcg tagcaataac tgattggtca
1141 ggatatagcg ggagttttgt ccagcatcca gaactgacag gattagattg cataagacct
1201 tgtttctggg ttgagttaat cagagggcgg cccaaagaga gcacaatttg gactagtggg
1261 agcagcatat ccttttgtgg tgtaaatagt gacactgtgg gttggtcttg gccagacggt
1321 gctgagttgc cattcaccat tgacaagtag
```

FIG. 122

Influenza Virus NA N2 (first example) (Type 2 protein)

MNPNQKIIALGSVSITIATICLLMQIAILATTMTLHFNECTNPS

NNQAVPCEPIIIERNITEIVHLNNTTIEKESCPKVAEYKNWSKPQCQITGFAPFSKDN

SIRLSAGGDIWVTREPYVSCGLGKCYQFALGQGTTLNNKHSNGTIHDRSPHRTLLMNE

LGVPFHLGTKQVCIAWSSSSCHDGKAWLHVCVTGDDRNATASIIYDGMLTDSIGSWSK

NILRTQESECVCINGTCTVVMTDGSASGRADTKILFIREGKIVHIGPLSGSAQHVEEC

SCYPRYPEVRCVCRDNWKGSNRPVLYINVADYSVDSSYVCSGLVGDTPRNDDSSSSSN

CRDPNNERGGPGVKGWAFDNGNDVWMGRTIKKDSRSGYETFRVVGGWTTANSKSQINR

QVIVDSDNWSGYSGIFSVEGKTCINRCFYVELIRGRPQETRVWWTSNSIIVFCGTSGT

YGTGSWPDGANINFMSI

FIG. 123

Influenza Virus NA  N2 type  (second example)   (Type 2 protein)

MNPNQKIITIGSVSLTIATICFLMQIAILVTTVTLHFKQYECNS

PPNNQVMLCEPTIIERNITEIVYLTNTTIEKEICPKLAEYRNWSKPQCNITGFAPFSK

DNSIRLSAGGDIWVTREPYVSCDPDKCYQFALGQGTTLNNGHSNDTVHDRTPYRTLLM

NELGVPFHLGTKQVCIAWSSSSCHDGKAWLHVCVTGDDENATASFIYNGRLVDSIGSW

SKKILRTQESECVCINGTCTVVMTDGSASGKADTKILFIEEGKIVHTSLLSGSAQHVE

ECSCYPRYPGVRCVCRDNWKGSNRPIVDINVKDYSIVSSYVCSGLVGDTPRKNDSSSS

SHCLDPNNEEGGHGVKGWAFDDGNDVWMGRTISEKLRSGYETFKVIEGWSKPNSKLQI

NRQVIVDRGNRSGYSGIFSVEGKSCINRCFYVELIRGRKQETEVLWTSNSIVVFCGTS

GTYGTGSWPDGADINLMPI

FIG. 124

Influenza Virus NA  N2 type (second example)   (Type 2 protein)

```
   1 atgaatccaa atcaaaagat aataacgatt ggctctgttt ctctcaccat tgccacaata
  61 tgcttcctta tgcaaattgc catcctggta actactgtaa cattgcattt caagcaatat
 121 gaatgcaact cccccccaaa caaccaagtg atgctgtgtg aaccaacaat aatagaaaga
 181 aacataacag agatagtgta tctgaccaac accaccatag agaaggaaat atgccccaaa
 241 ctagcagaat acagaaattg gtcaaagccg caatgtaaca ttacaggatt tgcaccttt
 301 tctaaggaca attcgattcg gctttccgct ggtgggaca tctgggtgac aagagaacct
 361 tatgtgtcat gcgatcctga caagtgttat caatttgccc ttggacaggg aacaacacta
 421 aacaacggac attcaaatga cacagtacat gataggaccc cttatcggac cctattgatg
 481 aatgagttgg gtgttccatt tcatttggga accaagcaag tgtgcatagc atggtccagc
 541 tcaagttgtc acgatggaaa agcatggctg catgtttgtg taacggggga tgatgaaaat
 601 gcaactgcta gcttcattta caatgggagg cttgtagata gtattggttc atggtccaaa
 661 aaaatcctca ggacccagga gtcggaatgc gtttgtatca atggaacttg tacagtagta
 721 atgactgatg ggagtgcttc aggaaaagct gatactaaaa tactattcat tgaggagggg
 781 aaaatcgttc atactagcct attgtcagga agtgctcagc atgtcgagga gtgctcctgt
 841 tatcctcgat accctggtgt cagatgtgtc tgcagagaca actggaaagg ctccaatagg
 901 cccatcgtag atataaatgt aaaggattat agcattgttt ccagttatgt gtgctcagga
 961 cttgttggag acacacccag aaaaacgac agctccagca gtagccattg cttggatcct
1021 aacaatgagg aaggtggtca tggagtgaaa ggctgggcct tgatgatgg aaatgacgtg
1081 tggatgggaa gaacgatcag cgagaagtta cgctcaggat atgaaacctt caaagtcatt
1141 gaaggctggt ccaaacctaa ctccaaattg cagataaata ggcaagtcat agttgacaga
1201 ggtaataggt ccggttattc tggtattttc tctgttgaag caaaagctg catcaatcgg
1261 tgcttttatg tggagttgat aaggggaagg aaacaggaaa ctgaagtctt gtggacctca
1321 aacagtattg ttgtgttttg tggcacctca ggtacatatg aacaggctc atggcctgat
1381 ggggcggaca tcaatctcat gcctatataa
```

FIG. 125

Influenza Virus NA N3 type (Type 2 protein)

MNPNQKIITIGVVNTTLSTIALLIGVGNLVFNTVIHEKIGNHQT

VIHPTITTPAVPNCSDTIITYNNTVINNITTTIITEAERLFKPPLPLCPFRGFFPFHK

DNAIRLGENKDVIVTREPYVSCDNDNCWSFALAQGALLGTKHSNGTIKDRTPYRSLIR

FPIGTAPVLGNYKEICIAWSSSSCFDGKEWMHVCMTGNDNDASAQIIYAGRMTDSIKS

WRKDILRTQESECQCIGGTCVVAVTDGPAANSADHRVYWIREGRIVKYENVPKTKIQH

LEECSCYVDIDVYCICRDNWKGSNRPWMRINNETILETGYVCSKFHSDTPRPADPSTV

SCDSPSNINGGPGVKGFGFKAGNDVWLGRTVSTSGRSGFEIIKVTDGWINSPNHAKSV

TQTLVSNNDWSGYSGSFIVKTKGCFQPCFYVELIRGRPNKNDDVSWTSNSIVTFCGLD

NEPGSGNWPDGSNIGFMPK

FIG. 126

Influenza Virus NA N3 type (Type 2 protein)

```
   1 atgaatccaa atcagaagat aataacaatc ggggtagtga acactactct atcaacaata
  61 gcccttctca ttggagtggg aaatctggtt ttcaacacag tcatacatga gaaaataggg
 121 aatcaccaaa cagtgattca cccaacaata acgactcctg cagtaccaaa ctgcagtgac
 181 actataataa catacaacaa cactgtgata acaacataa caacaacaat aataactgaa
 241 gcggaaaggc tttttaagcc tccactgccg ctgtgcccct tccgaggatt cttccctttt
 301 cacaaggaca atgcaatacg attgggtgag aacaaggacg tcatagtcac aagagaacct
 361 tatgttagct gtgataatga caattgttgg tccttcgctc tcgcacaagg agcactgtta
 421 gggactaaac atagcaatgg aaccatcaaa gacagaacac cgtataggtc tctaatccga
 481 ttcccaatag aacagcccc agtactggga aattacaagg agatatgcat tgcttggtcg
 541 agtagcagtt gctttgacgg gaaagagtgg atgcatgtat gcatgacagg gacgataat
 601 gatgcaagtg cccaaataat atatgcaggg agaatgacag actccatcaa atcatggaga
 661 aaggacatac taaggaccca agagtccgaa tgtcaatgca ttggcggaac ttgtgttgtt
 721 gctgttacag atggccctgc tgctaatagt gcagatcata gggtttattg gatacgggag
 781 gggagaatag tgaagtatga aaatgtccct aaaacaaaga tacaacactt agaagagtgt
 841 tcctgctatg tggacatcga tgtgtactgt atatgcaggg acaattggaa gggttccaac
 901 agaccttgga tgagaatcaa caacgagacc atactggaaa caggatatgt gtgcagcaaa
 961 tttcactcag acactcccag gccagctgac ccctcaacag tatcatgtga ttctccaagc
1021 aacattaatg gaggacccgg agttaaggga tttggcttca agccggcaa tgatgtgtgg
1081 ttgggcagga cagtgtcaac tagtggtaga tcaggctttg aaatcatcaa agttacagat
1141 gggtggatca actctcccaa tcacgccaaa tcagttacac aaacactagt gtccaacaat
1201 gattggtcag gctattcagg tagtttcatt gtcaaaacca agggctgttt ccagccctgc
1261 ttttatgtcg aacttatacg aggaaggccc aacaagaatg atgatgtctc ttggacaagc
1321 aatagtatag ttacttactg tgggttagac aatgaacctg gatcgggaaa ttggccggat
1381 ggttccaaca ttgggtttat gcccaagtaa cagaaaaaa
```

FIG. 127

Measles Virus HA Protein   (Type 2 protein)

MSPQRDRINAFYKDNPHPKGSRIVINREHLMIDRPYVLLAVLFV

MFLSLIGLLAIAGIRLHRAAIYTAENHKSLSTNLDVTNSIEHQVKDVLTPLFKIIGDE

VGLRTPQRFTDLVKFISDKIKFLNPDREYDFRDLTWCINPPERIKLDYDQYCADVAAE

ELMNALVNSTLLEARATNQFLAVSKGNCSGPTTIRGQFSNMSLSLLDLYLSRGYNVSS

IVTMTSQGMYGGTYLVEKPNLSSKGSELSQLSMHRVFEVGVIRNPGLGAPVFHMTNYF

EQPVSNDFSNCMVALGELKFAALCHREDSITIPYQGSGKGVSFQLVKLGVWKSPTDMR

SWVPLSTDDPVIDRLYLSSHRGVIADNQAKWAVPTTRTDDKLRMETCFQQACKGKNQA

LCENPEWAPLKDNRIPSYGVLSVNLSLTVELKIKIASGFGPLITHGSGMDLYKTNHNN

VYWLTIPPMKNLALGVINTLEWIPRFKVSPNLFTVPIKEAGEDCHAPTYLPAEVDGDV

KLSSNLVILPGQDLQYVLATYDTSRVEHAVVYYVYSPSRSFSYFYPFRLPIKGVPIEL

QVECFTWDKKLWCRHFCVLADSESGGHITHSGMVGMGVSCTVTREDGTNRR

FIG. 128

Measles Virus HA Protein   (Type 2 protein)

```
   1 agggtgcaag atcatccaca atgtcaccac aacgagaccg aataaatgcc ttctacaaag
  61 acaacccaca tcctaaggga agtaggatag ttattaacag agaacatctt atgattgata
 121 gaccttatgt tttgctggct gttctattcg tcatgtttct gagcttgatc gggttgctag
 181 ccattgcagg cattagactc catcgtgcag ccatctacac cgcagagaac cataagagcc
 241 tcagcaccaa tctagatgta actaactcaa tcgagcatca ggtcaaggac gtgctgacac
 301 cactcttcaa gatcattggt gatgaagtgg gcctgaggac acctcagaga ttcactgacc
 361 tagtgaaatt catctctgac aaaattaaat tccttaatcc ggatagggag tacgacttca
 421 gagatctcac ttggtgtatc aacccgccag agagaatcaa attggattat gatcaatact
 481 gtgcagatgt ggctgctgaa gaactcatga atgcattggt gaactcaact ctactggagg
 541 ccagggcaac caatcagttc ctagctgtct caaagggaaa ctgctcaggg cccactacaa
 601 tcagaggtca attctcaaac atgtcgctgt ccctgttgga cttgtattta agtcgaggtt
 661 acaatgtatc gtctatagtc actatgacat cccagggaat gtacgggga acttacctag
 721 tggaaaagcc taatctgagc agtaaagggt cagagttgtc acaactgagc atgcaccgag
 781 tgtttgaagt aggggttatc agaaatccgg gtttggggg tccggtgttc catatgacaa
 841 actattttga gcaaccagtc agtaatgatt tcagcaactg catggtggct ttggggagc
 901 ttaaattcgc agccctctgt cacagggaag attctatcac aattccctat caggggtcag
 961 ggaaaggtgt cagcttccag ctcgtcaagc taggtgtctg gaaatcccca accgacatgc
1021 gatcctgggt cccccctatca acggatgatc cagtgataga taggctttac ctctcatctc
1081 acagaggtgt tatcgctgac aatcaagcaa aatgggctgt cccgacaaca cggacagatg
1141 acaagttgcg aatggagaca tgcttccagc aggcgtgtaa gggtaaaaac caagcactct
1201 gcgagaatcc cgagtgggca ccattgaagg ataacaggat tccttcatac ggggtcttgt
1261 ctgttaatct gagtctgaca gttgagctta aaatcaaaat tgcttcagga ttcgggccat
1321 tgatcacaca cggttcaggg atggacctat acaaaaccaa ccacaacaat gtgtattggc
1381 tgactatccc gccaatgaag aacctagcct taggtgtaat caacacattg gagtggatac
1441 cgagattcaa ggttagtccc aacctcttca ctgttccaat caaggaagca ggcgaggact
1501 gccatgcccc aacataccta cctgcggagg tggatggtga tgtcaaactc agttccaatc
1561 tggtaattct acctggtcag gatctccaat atgttttggc aacctacgat acttccaggg
1621 ttgaacatgc tgtggttat tatgtttaca gcccaagccg ctcatttttct tactttttatc
1681 cttttaggtt gcctataaag gggtcccaa tcgaattaca agtggaatgc ttcacatggg
1741 acaaaaaact ctggtgccgt cacttctgtg tgcttgcgga ctcagaatct ggtggacata
1801 tcactcactc tgggatggtg ggcatgggag tcagctgcac agtcactcgg gaagatggaa
1861 ccaatcgcag atagggctgc cagtgaaccg atcacatgat gtcacccaga catcaggcat
1921 acccactagt gtgaaataga catcagaatt aag
```

FIG. 129

Mumps Virus HN (Type 2 protein)

MEPSKLFIMSDNATFAPGPVVNAAGKKTFRTCFRILVLSVQAVT

LILVIVTLGELIRMINDQGLSNQLSSITDKIRESAAMIASAVGVMNQVIHGVTVSLPL

QIEGNQNQLLSTLATICTNRNQVSNCSTNIPLVNDLRFINGINKFIIEDYATHDFSIG

HPLNMPSFIPTATSPNGCTRIPSFSLGKTHWCYTHNVINANCKDHTSSNQYVSMGILV

QTASGYPMFKTLKIQYLSDGLNRKSCSIATVPDGCAMYCYVSTQLETDDYAGSSPPTQ

KLTLLFYNDTIKERTISPSGLEGNWATLVPGVGSGIYFENKLIFPAYGGVLPNSTLGV

KSAREFFRPVNPYNPCSGPPQELDQRALRSYFPSYFSSRRVQSAFLVCAWNQILVTNC

ELVVPSNNQTLMGAEGRVLLINNRLLYYQRSTSWWPYELLYEISFTFTNSGQSSVNMS

WIPIYSFTRPGLGKCSGENICPTVCVSGVYLDPWPLTPYSHQSGINRNFYFTGALLNS

STTRVNPTLYVSALNNLKVLAPYGTQGLFASYTTTTCFQDTGDASVYCVYIMELASNI

VGEFQILPVLARLTIT

FIG. 130

Mumps Virus HN  (Type 2 protein)

```
   1 atggagccct cgaaactatt cataatgtcg gacaacgcca cctttgcacc tggacctgtt
  61 gttaatgcgg ctggtaagaa gacattccga acctgtttcc gaatattggt cctatctgta
 121 caagcagtta cccttatatt ggttattgtc actttaggtg agcttattag gatgatcaat
 181 gatcaaggct tgagcaatca gttgtcttca attacagaca agataagaga atcagctgct
 241 atgattgcat ctgctgtggg agtaatgaat caagtaattc atggagtaac ggtatcctta
 301 cccctacaaa ttgagggaaa ccaaaatcaa ttattatcca cacttgccac aatctgcaca
 361 aacagaaacc aagtttcaaa ctgctctaca acatcccct tagttaatga ccttaggttt
 421 ataaatggaa tcaataagtt catcattgaa gattatgcaa cccatgattt ctccatcggc
 481 catccactca acatgcctag ctttatccca actgcaacct cacccaatgg ttgcacaaga
 541 attccatcct tttctttagg taagacacat tggtgttaca cacataatgt aattaatgcc
 601 aactgcaagg atcatacttc atcgaaccaa tatgtttcca tggggattct cgttcaaacc
 661 gcgtcagggt atcccatgtt caaaacccta aaaatccaat atctcagtga tggcctgaat
 721 cggaaaagct gctcaattgc aacagtccct gatggttgcg caatgtactg ttacgtttca
 781 actcaacttg aaaccgacga ctatgcgggg tccagcccac ctacccagaa acttacccctg
 841 ttgttctata atgacaccat caaagaaagg acaatatctc cgtctggtct tgaaggaaat
 901 tgggctactt tggtgccagg agtggggagt ggaatatatt tcgaaaataa gttgatcttt
 961 cctgcatatg ggggtgtctt gcccaatagt acactaggag ttaaatcagc aagagaattt
1021 ttccggcccg ttaatccata taatccatgt tcaggaccac acaagagtt agatcagcgt
1081 gctttgagat catatttccc aagttacttc tctagtcgaa gggtacagag tgcatttctg
1141 gtctgtgcct ggaatcagat cctagttaca aattgcgagc tagttgtccc ctcaaacaat
1201 cagacactta gggtgcaga aggaagagtt ttattgatca ataatcggct attatattat
1261 cagaggagta ctagctggtg gccgtatgaa ctcctctatg agatatcatt cacatttaca
1321 aactctggtc aatcatctgt gaatatgtcc tggataccta tatattcatt cacccgtcct
1381 ggtttgggca aatgcagtgg tgaaaatata tgcccaacag tctgtgtatc aggagtttat
1441 cttgatccct ggccattaac tccatacagc catcaatcag gcattaacag aaatttctat
1501 ttcacaggtg cactgctaaa ttcaagcaca accagggtga atcctaccct ttatgtctct
1561 gcccttaata atcttaaagt actagcccca tatggtactc aaggattgtt tgcgtcatac
1621 accacaacca cctgctttca agataccggt gacgctagtg tgtattgtgt ctatattatg
1681 gaactagcat cgaatattgt tggagaattc caaattctac ctgtgctagc cagattgacc
1741 atcacttgag ttgtagtgaa tgtagtagga agctttatgg gcgtgtctca tttcttatcg
1801 attattaaga aaaacaggc c
```

FIG. 131

Nipah Virus G Protein (Type 2 protein)

MPAENKKVRFENTTSDKGKIPSKVIKSYYGTMDIKKINEGLLDS

KILSAFNTVIALLGSIVIIVMNIMIIQNYTRSTDNQAVIKDALQGIQQQIKGLADKIG

TEIGPKVSLIDTSSTITIPANIGLLGSKISQSTASINENVNEKCKFTLPPLKIHECNI

SCPNPLPFREYRPQTEGVSNLVGLPNNICLQKTSNQILKPKLISYTLPVVGQSGTCIT

DPLLAMDEGYFAYSHLERIGSCSRGVSKQRIIGVGEVLDRGDEVPSLFMTNVWTPPNP

NTVYHCSAVYNNEFYYVLCAVSTVGDPILNSTYWSGSLMMTRLAVKPKSNGGGYNQHQ

LALRSIEKGRYDKVMPYGPSGIKQGDTLYFPAVGFLVRTEFKYNDSNCPITKCQYSKP

ENCRLSMGIRPNSHYILRSGLLKYNLSDGENPKVVFIEISDQRLSIGSPSKIYDSLGQ

PVFYQASFSWDTMIKFGDVLTVNPLVVNWRNNTVISRPGQSQCPRFNTCPEICWEGVY

NDAFLIDRINWISAGVFLDSNQTAENPVFTVFKDNEILYRAQLASEDTNAQKTITNCF

LLKNKIWCISLVEIYDTGDNVIRPKLFAVKIPEQCT

FIG. 132

Nipah Virus G Protein (Type 2 protein)

```
            atgccggc agaaaacaag aaagttagat tcgaaaatac tacttcagac aaagggaaaa
     9001 ttcctagtaa agttattaag agctactacg gaaccatgga cattaagaaa ataaatgaag
     9061 gattattgga cagcaaaata ttaagtgctt tcaacacagt aatagcattg cttggatcta
     9121 tcgtgatcat agtgatgaat ataatgatca tccaaaatta cacaagatca acagacaatc
     9181 aggccgtgat caaagatgcg ttgcagggta tccaacagca gatcaaaggg cttgctgaca
     9241 aaatcggcac agagataggg cccaaagtat cactgattga cacatccagt accattacta
     9301 tcccagctaa cattgggctg ttaggttcaa agatcagcca gtcgactgca agtataaatg
     9361 agaatgtgaa tgaaaaatgc aaattcacac tgcctccctt gaaaatccac gaatgtaaca
     9421 tttcttgtcc taacccactc ccttttagag agtataggcc acagacagaa ggggtgagca
     9481 atctagtagg attacctaat aatatttgcc tgcaaaagac atctaatcag atattgaagc
     9541 caaagctgat ttcatacact ttacccgtag tcggtcaaag tggtacctgt atcacagacc
     9601 cattgctggc tatggacgag ggctattttg catatagcca cctggaaaga atcggatcat
     9661 gttcaagagg ggtctccaaa caaagaataa taggagttgg agaggtacta gacagaggtg
     9721 atgaagttcc ttctttattt atgaccaatg tctggacccc accaaatcca aacaccgttt
     9781 accactgtag tgctgtatac aacaatgaat tctattatgt actttgtgca gtgtcaactg
     9841 ttggagaccc tattctgaat agcacctact ggtccggatc tctaatgatg acccgtctag
     9901 ctgtgaaacc caagagtaat ggtgggggtt acaatcaaca tcaacttgcc ctacgaagta
     9961 tcgagaaagg gaggtatgat aaagttatgc cgtatggacc ttcaggcatc aaacagggtg
    10021 acaccctgta ttttcctgct gtaggatttt tggtcaggac agagtttaaa tacaatgatt
    10081 caaattgtcc catcacgaag tgtcaataca gtaaacctga aaattgcagg ctatctatgg
    10141 ggattagacc aaacagccat tatatccttc gatctggact attaaaaatac aatctatcag
    10201 atggggagaa ccccaaagtt gtattcattg aaatatctga tcaaagatta tctattggat
    10261 ctcctagcaa aatctatgat tctttgggtc aacctgtttt ctaccaagcg tcattttcat
    10321 gggatactat gattaaattt ggagatgttc taacagtcaa ccctctggtt gtcaattggc
    10381 gtaataacac ggtaatatca agacccggc aatcacaatg ccctagattc aatacatgtc
    10441 cagagatctg ctgggaagga gtttataatg atgcattcct aattgacaga atcaattgga
    10501 taagcgcggg tgtattcctt gacagcaatc agaccgcaga aaatcctgtt tttactgtat
    10561 tcaaagataa tgaaatactt tatagggcac aactggcttc tgaggacacc aatgcacaaa
    10621 aaacaataac taattgtttt ctcttgaaga ataagatttg gtgcatatca ttggttgaga
    10681 tatatgacac aggagacaat gtcataagac ccaaactatt cgcggttaag ataccagagc
    10741 aatgtacata a
```

FIG. 133

Parainfluenza Virus Type 2 HN Protein (Type 2 protein)

MEDYSNLSLKSIPKRTCRIIFRTATILGICTLIVLCSSILHEII

HLDVSSGLMDSDDSQQGIIQPIIESLKSLIALANQILYNVAIIIPLKIDSIETVIFSA

LKDMHTGSMSNTNCTPGNLLLHDAAYINGINKFLVLKSYNGTPKYGPLLNIPSFIPSA

TSPNGCTRIPSFSLIKTHWCYTHNVMLGDCLDFTTSNQYLAMGIIQQSAAAFPIFRTM

KTIYLSDGINRKSCSVTAIPGGCVLYCYVATRSEKEDYATTDLAELRLAFYYYNDTFI

ERVISLPNTTGQWATINPAVGSGIYHLGFILFPVYGGLISGTPSYNKQSSRYFIPKHP

NITCAGNSSEQAAAARSSYVIRYHSNRLIQSAVLICPLSDMHTARCNLVMFNNSQVMM

GAEGRLYVIDNNLYYYQRSSSWWSASLFYRINTDFSKGIPPIIEAQWVPSYQVPRPGV

MPCNATSFCPANCITGVYADVWPLNDPEPTSQNALNPNYRFAGAFLRNESNRTNPTFY

TASASALLNTTGFNNTNHKAAYTSSTCFKNTGTQKIYCLIIIEMGSSLLGEFQIIPFL

RELIP

FIG. 134

Parainfluenza Virus Type 2 HN Protein (Type 2 protein)

```
                                         atgg aagattacag caatctatct
6841 cttaaatcaa ttcctaaaag gacatgtaga atcattttcc gaactgccac aattcttgga
6901 atatgcacat tgattgttct atgttcaagt attcttcatg agataattca tcttgatgtt
6961 tcctctggtc tcatggattc cgatgattca cagcaaggca ttattcagcc tattatagaa
7021 tcattaaaat cattaattgc tttggctaac cagattctgt acaatgttgc aataataatt
7081 cctcttaaaa ttgacagtat cgagactgta atattctctg ctttaaagga tatgcatact
7141 gggagcatgt ccaacaccaa ctgtacaccc ggaaatctgc ttctgcatga tgcagcgtac
7201 atcaatggaa taaacaaatt ccttgtactt aaatcataca atgggacgcc taaatatgga
7261 cctctcctaa atattcccag ctttatcccc tcagcaacat ctcccaacgg gtgcactaga
7321 ataccatcat tttcactcat taagacccat ggtgttaca ctcacaatgt aatgcttgga
7381 gattgcctcg atttcacgac atctaatcag tatttagcaa tggggataat acaacaatct
7441 gctgcagcat ttccaatctt caggactatg aaaaccattt acctaagtga tggaatcaat
7501 cgcaaaagct gttcagtcac tgctatacca ggaggttgtg tcttgtattg ctatgtagct
7561 acaagatctg agaaagaaga ttatgccaca actgatctag ctgaactgag acttgctttc
7621 tattattata atgataccct tattgaaaga gtcatatctc ttccaaatac aacagggcaa
7681 tgggccacaa tcaatcctgc agttggaagc gggatctatc atctaggctt tatcttattt
7741 cctgtatatg gtggtctcat aagtgggact ccttcctaca caagcagtc ctcacgctat
7801 tttatcccaa aacatcccaa cataacctgt gccggtaact ccagcgaaca ggctgcagca
7861 gcacggagtt cctatgtaat ccgttatcac tcaaacaggt tgattcagag tgctgttctt
7921 atttgcccat tgtctgacat gcacacagca aggtgtaatc tagttatgtt taacaattct
7981 caagtcatga tgggtgcaga aggtaggctc tatgttattg acaataattt gtattattat
8041 caacgtagtt cctcttggtg gtctgcatcg cttttttaca ggatcaatac agattttct
8101 aaaggaattc ctcctatcat tgaggctcaa tgggtaccgt cctatcaagt tccccgtcct
8161 ggagtcatgc catgcaatgc aacaagtttt tgccctgcta attgcatcac aggggtgtac
8221 gcagatgtgt ggccgcttaa cgatccagaa cccacatcac aaaatgctct gaatcccaac
8281 tatcgatttg ctggagcctt tctcagaaat gagtccaacc gaaccaatcc cacattctac
8341 actgcatcag ccagcgccct actaaatact accggattca acaacaccaa tcacaaagca
8401 gcatatacgt cttcaacctg ctttaagaat actggaactc aaaagattta ttgtttgata
8461 ataattgaaa tgggctcatc tcttttaggg gagttccaaa taataccatt tctaagggaa
8521 ctaataccttt aat
```

FIG. 135

Parainfluenza Virus 3 HN Glycoprotein (first example) (Type 2 protein)

meywkhtnhg kdagnelets matngnkltn kityilwtii lvllsivfii vlinsiksek ahesllqdin nefmeiteki qmasdntndl iqsgvntrll tiqshvqnyi pisltqqmsd lrkfiseiti rndnqevlpq rithdvgikp lnpddfwrct sglpslmktp kirlmpgpgl lampttvdgc irtpslvind liyaytsnli trgcqdigks yqvlqigiit vnsdlvpdln prishtfnin dnrkscslal lntdvyqlcs tpkvdersdy assgiedivl divnydgsis ttrfknnnis fdqpyaalyp svgpgiyykg kiiflgyggl ehpinenvic nttgcpgktq rdcnqashsp wfsdrrmvns iivvdkglns ipklkvwtis mrqnywgseg rllllgnkiy iytrstswhs klqlgiidit dysdirikwt whnvlsrpgn necpwghscp dgcitgvytd ayplnptgsi vssvildsqk srvnpvitys tatervnela irnrtlsagy tttscithyn kgycfhivei nqkslntlqp mlfktevpks cs

FIG. 136

Parainfluenza 3 Virus HN (second example) (Type 2 protein)

MAEKGKTNSSYWSTTRNDNSTVNTHINTPAGRTHIWLLIATTMH

TVLSFIIMILCIDLIIKQDTCMKTNIMTVSSMNESAKIIKETITELIRQEVISRTINI

QSSVQSGIPILLNKQSRDLTQLIEKSCNRQELAQICENTIAIHHADGISPLDPHDFWR

CPVGEPLLSNNPNISLLPGPSLLSGSTTISGCVRLPSLSIGDAIYAYSSNLITQGCAD

IGKSYQVLQLGYISLNSDMYPDLNPVISHTYDINDNRKSCSVIAAGTRGYQLCSLPTV

NETTDYSSEGIEDLVFDILDLKGKTKSHRYKNEDITFDHPFSAMYPSVGSGIKIENTL

IFLGYGGLTTPLQGDTKCVINRCTNVNQSVCNDALKITWLKKRQVVNVLIRINNYLSD

RPKIVVETIPITQNYLGAEGRLLKLGKKIYIYTRSSGWHSNLQIGSLDINNPMTIKWA

PHEVLSRPGNQDCNWYNRCPRECISGVYTDAYPLSPDAVNVATTTLYANTSRVNPTIM

YSNTSEIINMLRLKNVQLEAAYTTTSCITHFGKGYCFHIVEINQASLNTLQPMLFKTS

IPKICKITS

FIG. 137

Parainfluenza 3 Virus HN (second example) (Type 2 protein)

```
                                                  atggctgaa aaagggaaaa
2041 caaatagttc atattggtct acaacccgaa atgacaattc cacggtaaac acacacatta
2101 atacaccagc aggaaggaca cacatctggc tactgattgc aacaacaatg catacagtat
2161 tgtccttcat tatcatgatc ctatgcattg acctaattat aaaacaagac acttgtatga
2221 agacaaacat catgacagta tcctccatga acgaaagtgc caaaataatc aaagagacaa
2281 tcacagaatt aatcagacaa gaagtaatat caaggaccat aaacatacaa agttcagtac
2341 aaagcgggat cccaatattg ttaaacaagc aaagcagaga tctcacacaa ttaatagaga
2401 agtcatgcaa cagacaggaa ttggctcaga tatgcgaaaa caccattgct attcaccatg
2461 cagacggcat atctcctctg gacccacacg atttctggag atgtcccgta ggggaacccc
2521 tactgagcaa caaccccaat atctcattat tacctggacc aagtctactt tctggatcca
2581 ccacaatttc aggatgtgtt agactaccct cattatcaat tggtgatgca atatatgcgt
2641 attcatcaaa cttaatcact caaggatgtg cagatatagg gaagtcatat caggttttac
2701 aattaggtta catatcctta aattcagata tgtatcctga tttaaacccg gtaatttctc
2761 atacctatga catcaacgac aacaggaaat catgttctgt aatagctgca ggaacaaggg
2821 gttatcagtt atgctccttg cccactgtga atgagactac agactactcg agtgaaggta
2881 tagaagattt agtatttgac atattagatc tcaagggaaa gaccaaatct catcgataca
2941 aaaatgaaga tataactttt gaccatcctt tttctgcaat gtatccgagt gtaggaagtg
3001 ggataaaaat tgaaaataca ctcattttcc tagggtacgg tggcttaaca actccgctcc
3061 aaggcgacac taagtgtgtg ataaacagat gtaccaatgt taatcagagt gtttgcaatg
3121 atgctcttaa gataacttgg ctaaagaaaa gacaagttgt caatgtctta attcgtatca
3181 ataattattt atctgatagg ccaaagattg ttgtcgagac aattccaata actcaaaatt
3241 acttaggtgc cgaaggtagg ctacttaaac taggtaaaaa gatctacata tatactagat
3301 cttcaggttg gcactccaac ctgcaaatag gatcattaga tatcaacaac cccatgacca
3361 ttaaatgggc gcctcatgaa gtcctgtctc gaccaggaaa ccaagactgc aactggtaca
3421 acagatgtcc gagagaatgc atatcaggtg tatatactga tgcatatcca ctatctcctg
3481 atgcagtcaa tgttgctaca accacactgt acgcaaacac atcacgtgtt aatcccacca
3541 taatgtactc aaatacctca gaattatca acatgctaag actcaagaat gtacaactag
3601 aggcagcata cactactaca tcatgtatca ctcatttcgg gaagggctac tgcttccaca
3661 ttgttgaaat caaccaagcc agccttaata ccttacaacc tatgttgttc aagacaagta
3721 tccctaaaat atgtaaaatc acatcttaag
```

FIG. 138

Respiratory Syncytial Virus G Protein (Type 2 protein)

MSKNKNQRTARTLEKTWDTLNHLIVISSCLYKLNLKSIAQIALS

VLAMIISTSLIIAAIIFIISANHKVTLTTVTVQTIKNHTEKNITTYLTQVSPERVSPS

KQPTTTPPIHTNSATISPNTKSETHHTTAQTKGRTTTPTQNNKPSTKPRPKNPPKKPK

DDYHFEVFNFVPCSICGNNQLCKSICKTIPSNKPKKKPTIKPTNKPPTKTTNKRDSKT

LAKTLKKETTINPTKKPTPKTTERDTSTLQSIVLDTTTSKHTERDTSTSQSIVLDTTT

SKHTIQQQSLHSTTPENTPNSTQTPTASEPSTSNSNQKL

FIG. 139

Respiratory Syncytial Virus G Protein (Type 2 protein)

```
  1 ggggcaaatg caaacatgtc caaaaacaag aatcaacgta ctgccaggac tctagaaaag
 61 acctgggata ctcttaatca tctaattgta atatcctctt gtttatacaa attaaattta
121 aaatctatag cacaaatagc actatcagtt ttggcaatga taatctcaac ctctctcata
181 attgcagcca taatattcat catctctgcc aatcacaaag ttacactaac aactgtcaca
241 gttcaaacaa taaaaaacca cactgagaaa aacatcacca cttaccttac tcaagtctca
301 ccagaaaggg ttagcccatc caaacaaccc acaaccacac caccaatcca cacaaactca
361 gccacaatat cacccaatac aaaatcagaa acacaccata caacagcaca aaccaaaggc
421 agaaccacca ctccaacaca gaacaacaag ccaagcacaa aaccacgtcc aaaaaatcca
481 ccaaaaaaac caaaagatga ttaccatttt gaagtgttca acttcgttcc ctgtagtata
541 tgtggcaaca atcaactctg caatccatt tgcaaaacaa taccaagcaa taaaccaaag
601 aaaaaaccaa ccataaaacc cacaaacaaa ccacccacca aaaccacaaa caaaagagac
661 tcaaaaacac tagccaaaac actgaaaaaa gaaaccacca tcaacccaac aaaaaaacca
721 accccaaga ccacagaaag agacaccagc accctacaat ccattgtgct tgacacaacc
781 acatcaaaac acacagaaag agacaccagc acctcacaat ccattgtgct agacacaacc
841 acatcaaaac acacaatcca acagcaatcc ctccactcaa ccaccccga aaacacaccc
901 aactccacac aaacacccac agcatccgag ccctccacat caaattccaa ccaaaaactc
961 tagtcatatg cttagttatt c
```

FIG. 140

Vaccinia Virus Surface Antigen (Type 2 protein)

MTMKMMVHIYFVSLLLLLFHSYAIDIENEITEFFNKMRDTLPAK

DSKWLNPACMFGGTMNDIAALGEPFSAKCPPIEDSLLSHRYKDYVVKWERLEKNRRRQ

VSNKRVKHGDLWIANYTSKFSNRRYLCTVTTKNGDCVQGIVRSHIKKPPSCIPKTYEL

GTHDKYGIDLYCGILYAKHYNNITWYKDNKEINIDDIKYSQTGKKLIIHNPELEDSGR

YNCYVHYDDVRIKNDIVVSRCKILTVIPSQDHRFKLILDPKINVTIGEPANITCTAVS

TSLLIDDVLIEWENPSGWLIGFDFDVYSVLTSRGGITEATLYFENVTEEYIGNTYKCR

GHNYYFEKTLTTTVVLE

FIG. 141

Vaccinia Virus Surface Antigen (Type 2 protein)

```
   1 tctagacact acactatatg cagttttaag atgccataat tcgaaaaagt taagaagata
  61 cctcaacgag ttaaaaaaat ataataacga taagtccttt aaaatatatt ctaatattat
 121 gaatgagaga taccttaatg tatattataa agatatgtac gtgtcaaagg tatatgataa
 181 actatttcct gttttcacag ataaaaattg tctactaaca ttactacctt cagaaattat
 241 atacgaaata ttatacatgc tgacaattaa cgatctttat aatatatcgt atccacctac
 301 caaagtatag ttgtatttt ctcatgcgat gtgtgtaaaa aaactgatat tatataaata
 361 ttttagtgcc gtaataaaa gatgacgatg aaaatgatgg tacatatata tttcgtatca
 421 ttattgttat tgctattcca cagttacgcc atagacatcg aaaatgaaat cacagaattc
 481 ttcaataaaa tgagagatac tctaccagct aaagactcta atggttgaa tccagcatgt
 541 atgttcggag gcacaatgaa tgatatagcc gctctaggag agccattcag cgcaaagtgt
 601 cctcctattg aagacagtct tttatcgcac agatataaag actatgtggt taaatgggaa
 661 aggctagaaa aaaatagacg gcgacaggtt tctaataaac gtgttaaaca tggtgattta
 721 tggatagcca actatacatc taaattcagt aaccgtaggt atttgtgtac cgtaactaca
 781 aagaatggtg actgtgttca gggtatagtt agatctcata ttaaaaaacc tccttcatgc
 841 attccaaaaa catatgaact aggtactcat gataagtatg catagactt atactgtgga
 901 attctttacg caaaacatta taataatata acttggtata aagataataa ggaaattaat
 961 atcgacgata ttaagtattc acaaacggga agaaattaa ttattcataa tccagagtta
1021 gaagatagtg gaagatacaa ctgttacgtt cattacgacg acgttagaat caagaatgat
1081 atcgtagtat caagatgtaa aatacttacg gttataccgt cgcaagacca caggtttaaa
1141 ctaatactag atccaaaaat caacgtaacg ataggagaac ctgccaatat aacatgcact
1201 gctgtgtcaa cgtcattatt gattgacgat gtactgattg aatgggaaaa tccatccgga
1261 tggcttatag gattcgattt tgatgtatac tctgttttaa ctagtagagg cggtatcacc
1321 gaggcgacct tgtactttga aaatgttact gaagaatata taggtaatac atataaatgt
1381 cgtggacaca actattattt tgaaaaaacc cttacaacta cagtagtatt ggagtaaata
1441 cacaatgcat ttttatatac attactgaat aattattatt attatttata tcgtatttgt
1501 gctatagaat gaatgaggat acgcg
```

FIG. 142

Epstein Barr Virus (EBV) LMP2A protein (Type 3 protein)

MGSLEMVPMGAGPPSPGGDPDGYDGGNNSQYPSASGSSGNTPTP

PNDEERESNEEPPPPYEDPYWGNGDRHSDYQPLGTQDQSLYLGLQHDGNDGLPPPPYS

PRDDSSQHIYEEAGRGSMNPVCLPVIVAPYLFWLAAIAASCFTASVSTVVTATGLALS

LLLLAAVASSYAAAQRKLLTPVTVLTAVVTFFAICLTWRIEDPPFNSLLFALLAAAGG

LQGIYVLVMLVLLILAYRRRWRRLTVCGGIMFLACVLVLIVDAVLQLSPLLGAVTVVS

MTLLLLAFVLWLSSPGGLGTLGAALLTLAAALALLASLILGTLNLTTMFLLMLLWTLV

VLLICSSCSSCPLSKILLARLFLYALALLLLASALIAGGSILQTNFKSLSSTEFIPNL

FCMLLLIVAGILFILAILTEWGSGNRTYGPVFMCLGGLLTMVAGAVWLTVMSNTLLSA

WILTAGFLIFLIGFALFGVIRCCRYCCYYCLTLESEERPPTPYRNTV

FIG. 143

Epstein Barr Virus (EBV) LMP2A protein (Type 3 protein)

first exon

```
                              ctatggggtc cctagaaatg gtgccaatgg gcgcgggtcc
     166141 ccctagcccc ggcggggatc cggatgggta cgatggcgga aacaactccc aatatccatc
     166201 tgcttctggc tcttctggga acacccccac cccaccgaac gatgaggaac gtgaatctaa
     166261 tgaagagccc ccaccgcctt atgaggaccc atattggggc aatggcgacc gtcactcgga
     166321 ctatcaacca ctaggaaccc aagatcaaag tctgtacttg ggattgcaac acgacgggaa
     166381 tgacgggctc cctccccctc cctactctcc acgggatgac tcatctcaac acatatacga
     166441 agaagcgggc agaggaaggt
``` second exon

```
                                                                       tat
         61 gaatccagta tgcctgcctg taattgttgc gccctacctc ttttggctgg cggctattgc
        121 cgcctcgtgt ttcacggcct cagttagtac cgttgtgacc gccaccggct tggccctctc
        181 acttctactc ttggcagcag tggccagctc atatgccgct gcacaaagga aactgctgac
        241 accggtgaca gtgcttactg cggttgtcac tt
``` third exon

```
                                                                         t
        361 ctttgcaatt tgcctaacat ggaggattga ggacccacct tttaattctc ttctgtttgc
        421 attgctggcc gcagctggcg gactacaagg catttacg
``` forth exon

```
                                                                         t
        541 tctggtgatg cttgtgctcc tgatactagc gtacagaagg agatggcgcc gtttgactgt
        601 ttgtggcggc atcatgtttt ggcatgtgt acttgtcctc atcgtcgacg ctgttttgca
        661 gctgagtccc ctccttggag ctgtaactgt ggtttccatg acgctgctgc tactggcttt
        721 cgtcctctgg ctctcttcgc caggggcct aggtactctt ggtgcagccc ttttaacatt
        781 ggcagcag
``` fifth exon

```
                                               ctctggcact gctagcgtca ctgattttgg
        901 gcacacttaa cttgactaca atgttccttc tcatgctcct atggacactt g
``` sixth exon

```
              tggtt ctcctgattt gctcttcgtg ctcttcatgt ccactgagca agatccttct
       1081 ggcacgactg ttcctatatg ctctcgcact cttgttgcta gcctccgcgc taatcgctgg
       1141 tgcagtatt ttgcaaacaa acttcaagag tttaagcagc actgaattta taccca
``` seventh exon

```
                      a tttgttctgc atgttattac tgattgtcgc tggcatactc
       1321 ttcattcttg ctatcctgac cgaatggggc agtggaaata gaacatacgg tccagttttt
       1381 atgtgcctcg gtggcctgct caccatggta gccggcgctg tgtggctgac ggtgatgtct
       1441 aacacgcttt tgtct
``` eighth exon

```
                 gctttgc cctctttggg gtcattagat gctgccgcta ctgctgctac
       1621 tactgcctta cactggaaag tgaggagcgc ccaccgaccc catatcgcaa cactgtataa
       1681 aggtaagtat tattaaattt tagagacact atcacgtgta acttgacgtg caaggatgga
```

FIG. 144

Glut 1 HTLV receptor protein (Type 3 protein)

MEPSSKKLTGRLMLAVGGAVLGSLQFGYNTGVINAPQKVIEEFY

NQTWVHRYGESILPTTLTTLWSLSVAIFSVGGMIGSFSVGLFVNRFGRRNSMLMMNLL

AFVSAVLMGFSKLGKSFEMLILGRFIIGVYCGLTTGFVPMYVGEVSPTAFRGALGTLH

QLGIVVGILIAQVFGLDSIMGNKDLWPLLLSIIFIPALLQCIVLPFCPESPRFLLINR

NEENRAKSVLKKLRGTADVTHDLQEMKEESRQMMREKKVTILELFRSPAYRQPILIAV

VLQLSQQLSGINAVFYYSTSIFEKAGVQQPVYATIGSGIVNTAFTVVSLFVVERAGRR

TLHLIGLAGMAGCAILMTIALALLEQLPWMSYLSIVAIFGFVAFFEVGPGPIPWFIVA

ELFSQGPRPAAIAVAGFSNWTSNFIVGMCFQYVEQLCGPYVFIIFTVLLVLFFIFTYF

KVPETKGRTFDEIASGFRQGGASQSDKTPEELFHPLGADSQV

FIG. 145

Glut 1 HTLV receptor protein (Type 3 protein)

```
   1 tagtcgcggg tccccgagtg agcacgccag ggagcaggag accaaacgac ggggtcgga
  61 gtcagagtcg cagtgggagt ccccggaccg gagcacgagc ctgagcggga gagcgccgct
 121 cgcacgcccg tcgccacccg cgtacccggc gcagccagag ccaccagcgc agcgctgcca
 181 tggagcccag cagcaagaag ctgacgggtc gcctcatgct ggctgtggga ggagcagtgc
 241 ttggctccct gcagtttggc tacaacactg gagtcatcaa tgcccccag aaggtgatcg
 301 aggagttcta caaccagaca tgggtccacc gctatgggga gagcatcctg cccaccacgc
 361 tcaccacgct ctggtccctc tcagtggcca tcttttctgt tggggcatg attggctcct
 421 tctctgtggg ccttttcgtt aaccgctttg gccggcggaa ttcaatgctg atgatgaacc
 481 tgctggcctt cgtgtccgcc gtgctcatgg gcttctcgaa actgggcaag tcctttgaga
 541 tgctgatcct gggccgcttc atcatcggtg tgtactgcgg cctgaccaca ggcttcgtgc
 601 ccatgtatgt gggtgaagtg tcacccacag cctttcgtgg ggccctgggc accctgcacc
 661 agctgggcat cgtcgtcggc atcctcatcg cccaggtgtt cggcctggac tccatcatgg
 721 gcaacaagga cctgtggccc ctgctgctga gcatcatctt catcccggcc ctgctgcagt
 781 gcatcgtgct gcccttctgc cccgagagtc cccgcttcct gctcatcaac cgcaacgagg
 841 agaaccgggc caagagtgtg ctaaagaagc tgcgcgggac agctgacgtg acccatgacc
 901 tgcaggagat gaaggaagag agtcggcaga tgatgcggga agaaggtc accatcctgg
 961 agctgttccg ctcccccgcc taccgccagc ccatcctcat cgctgtggtg ctgcagctgt
1021 cccagcagct gtctggcatc aacgctgtct ctattactc cacgagcatc ttcgagaagg
1081 cggggtgca gcagcctgtg tatgccacca ttggctccgg tatcgtcaac acggccttca
1141 ctgtcgtgtc gctgtttgtg gtggagcgag caggccggcg gaccctgcac ctcataggcc
1201 tcgctggcat ggcgggttgt gccatactca tgaccatcgc gctagcactg ctggagcagc
1261 taccctggat gtcctatctg agcatcgtgg ccatctttgg cttttgtgcc ttctttgaag
1321 tgggtcctgg ccccatccca tggttcatcg tggctgaact cttcagccag ggtccacgtc
1381 cagctgccat tgccgttgca ggcttctcca actggaccct aaatttcatt gtgggcatgt
1441 gcttccagta tgtggagcaa ctgtgtggtc cctacgtctt catcatcttc actgtgctcc
1501 tggttctgtt cttcatcttc acctacttca agttcctga gactaaaggc cggaccttcg
1561 atgagatcgc ttccggcttc cggcaggggg gagccagcca agtgataag acacccgagg
1621 agctgttcca tccctgggg gctgattccc aagtgtgagt cgcccagat caccagcccg
1681 gcctgctccc agcagcccta aggatctctc aggagcacag gcagctggat gagacttcca
1741 aacctgacag atgtcagccg agccgggcct ggggctcctt tctccagcca gcaatgatgt
1801 ccagaagaat attcaggact taacggctcc aggattttaa caaaagcaag actgttgctc
1861 aaatctattc agacaagcaa caggttttat aattttttta ttactgattt tgttattttt
1921 atatcagcct gagtctcctg tgcccacatc ccaggcttca ccctgaatgg ttccatgcct
1981 gagggtggag actaagccct gtcgagacac ttgccttctt cacccagcta atctgtaggg
2041 ctggacctat gtcctaagga cacactaatc gaactatgaa ctacaaagct tctatcccag
2101 gaggtggcta tggccacccg ttctgctggc ctggatctcc ccactctagg ggtcaggctc
2161 cattaggatt tgccccttcc catctcttcc tacccaacca ctcaaattaa tctttctta
2221 cctgagacca gttgggagca ctggagtgca gggaggagag gggaagggcc agtctgggct
2281 gccgggttct agtctccttt gcactgaggg ccacactatt accatgagaa gagggcctgt
2341 gggagcctgc aaactcactg ctcaagaaga catggagact cctgccctgt tgtgtataga
2401 tgcaagatat ttatatat ttttggttgt caatattaaa tacagacact aagttatagt
2461 atatctggac aagccaactt gtaaatacac cacctcactc ctgttactta cctaaacaga
2521 tataaatggc tggttttag aaacatggtt ttgaaatgct tgtggattga gggtaggagg
2581 tttggatggg agtgagacag aagtaagtgg ggttgcaacc actgcaacgg cttagacttc
2641 gactcaggat ccagtccctt acacgtacct ctcatcagtg tcctcttgct caaaaatctg
2701 tttgatccct gttacccaga gaatatatac attctttatc ttgacattca aggcatttct
2761 atcacatatt tgatagttgg tgttcaaaaa aacactagtt ttgtgccagc cgtgatgctc
2821 aggcttgaaa tcgcattatt ttgaatgtga agggaa
```

FIG. 146

Glutamate Receptor protein (Type 3 protein)

MSTMRLLTLALLFSCSVARAACDPKIVNIGAVLSTRKHEQMFRE
AVNQANKRHGSWKIQLNATSVTHKPNAIQMALSVCEDLISSQVYAILVSHPPTPNDHF
TPTPVSYTAGFYRIPVLGLTTRMSIYSDKSIHLSFLRTVPPYSHQSSVWFEMMRVYSW
NHIILLVSDDHEGRAAQKRLETLLEERESKAEKVLQFDPGTKNVTALLMEAKELEARV
IILSASEDDAATVYRAAAMLNMTGSGYVWLVGEREISGNALRYAPDGILGLQLINGKN
ESAHISDAVGVVAQAVHELLEKENITDPPRGCVGNTNIWKTGPLFKRVLMSSKYADGV
TGRVEFNEDGDRKFANYSIMNLQNRKLVQVGIYNGTHVIPNDRKIIWPGGETEKPRGY
QMSTRLKIVTIHQEPFVYVKPTLSDGTCKEEFTVNGDPVKKVICTGPNDTSPGSPRHT
VPQCCYGFCIDLLIKLARTMNFTYEVHLVADGKFGTQERVNNSNKKEWNGMMGELLSG
QADMIVAPLTINNERAQYIEFSKPFKYQGLTILVKKEIPRSTLDSFMQPFQSTLWLLV
GLSVHVVAVMLYLLDRFSPFGRFKVNSEEEEEDALTLSSAMWFSWGVLLNSGIGEGAP
RSFSARILGMVWAGFAMIIVASYTANLAAFLVLDRPEERITGINDPRLRNPSDKFIYA
TVKQSSVDIYFRRQVELSTMYRHMEKHNYESAAEAIQAVRDNKLHAFIWDSAVLEFEA
SQKCDLVTTGELFFRSGFGIGMRKDSPWKQNVSLSILKSHENGFMEDLDKTWVRYQEC
DSRSNAPATLTFENMAGVFMLVAGGIVAGIFLIFIEIAYKRHKDARRKQMQLAFAAVN
VWRKNLQDRKSGRAEPDPKKKATFRAITSTLASSFKRRRSSKDTSTGGGRGALQNQKD
TVLPRRAIEREEGQLQLCSRHRES

FIG. 147

Glutamate Receptor protein (Type 3 protein)

```
   1 gtacaaaaaa gcagaagggc cgtcaaggcc caccatgagc accatgcgcc tgctgacgct
  61 cgccctgctg ttctcctgct ccgtcgcccg tgccgcgtgc gaccccaaga tcgtcaacat
 121 tggcgcggtg ctgagcacgc ggaagcacga gcagatgttc cgcgaggccg tgaaccaggc
 181 caacaagcgg cacggctcct ggaagattca gctcaatgcc acctccgtca cgcacaagcc
 241 caacgccatc cagatggctc tgtcggtgtg cgaggacctc atctccagcc aggtctacgc
 301 catcctagtt agccatccac ctaccccaa cgaccacttc actcccaccc ctgtctccta
 361 cacagccggc ttctaccgca tacccgtgct ggggctgacc acccgcatgt ccatctactc
 421 ggacaagagc atccacctga gcttcctgcg caccgtgccg ccctactccc accagtccag
 481 cgtgtggttt gagatgatgc gtgtctacag ctggaaccac atcatcctgc tggtcagcga
 541 cgaccacgag ggccggcgg ctcagaaacg cctggagacg ctgctggagg agcgtgagtc
 601 caaggcagag aaggtgctgc agtttgaccc agggaccaag aacgtgacgg ccctgctgat
 661 ggaggcgaaa gagctggagg cccgggtcat catcctttct gccagcgagg acgatgctgc
 721 cactgtatac cgcgcagccg cgatgctgaa catgacgggc tccgggtacg tgtggctggt
 781 cggcgagcgc gagatctcgg ggaacgccct gcgctacgcc cagacggca tcctcgggct
 841 gcagctcatc aacggcaaga cgagtcggc ccacatcagc gacgccgtgg cgtggtggc
 901 ccaggccgtg cacgagctcc tcgagaagga aacatcacc gacccgccgc ggggctgcgt
 961 gggcaacacc aacatctgga agaccgggcc gctcttcaag agagtgctga tgtcttccaa
1021 gtatgcggat ggggtgactg gtcgcgtgga gttcaatgag gatggggacc ggaagttcgc
1081 caactacagc atcatgaacc tgcagaaccg caagctggtg caagtgggca tctacaatgg
1141 cacccacgtc atccctaatg acaggaagat catctggcca ggcggagaga cagagaagcc
1201 tcgagggtac cagatgtcca ccagactgaa gattgtgacg atccaccagg agcccttcgt
1261 gtacgtcaag cccacgctga gtgatgggac atgcaaggag gagttcacag tcaacggcga
1321 cccagtcaag aaggtgatct gcaccgggcc caacgacacg tcgccgggca gccccgcca
1381 cacggtgcct cagtgttgct acggcttttg catcgacctg ctcatcaagc tggcacggac
1441 catgaacttc acctacgagg tgcacctggt ggcagatggc aagttcggca cacaggagcg
1501 ggtgaacaac agcaacaaga aggagtggaa tgggatgatg ggcgagctgc tcagcgggca
1561 ggcagacatg atcgtggccg cgctaacat aaacaacgag cgcgcgcagt acatcgagtt
1621 ttccaagccc ttcaagtacc agggcctgac tattctggtc aagaaggaga ttccccggag
1681 cacgctggac tcgttcatgc agccgttcca gagcacactg tggctgctgg tggggctgtc
1741 ggtgcacgtg gtggccgtga tgctgtacct gctggaccgc ttcagcccct tcggccggtt
1801 caaggtgaac agcgaggagg aggaggagga cgcactgacc ctgtcctcgg ccatgtggtt
1861 ctcctggggc gtcctgctca actccggcat cggggaaggc gcccccagaa gcttctcagc
1921 gcgcatcctg ggcatggtgt gggccggctt tgccatgatc atcgtggcct cctacaccgc
1981 caacctggcg gccttcctgg tgctggaccg gccggaggag cgcatcacgg gcatcaacga
2041 ccctcggctg aggaacccct cggacaagtt tatctacgcc acggtgaagc agagctccgt
2101 ggatatctac ttccggcgcc aggtggagct gagcaccatg taccggcata tggagaagca
2161 caactacgag agtgcggcgg aggccatcca ggccgtgaga gacaacaagc tgcatgcctt
2221 catctgggac tcggcggtgc tggagttcga ggcctcgcag aagtgcgacc tggtgacgac
2281 tggagagctg ttttccgct cgggcttcgg cataggcatg cgcaaagaca gccctggaa
2341 gcagaacgtc tccctgtcca tcctcaagtc ccacgagaat ggcttcatgg aagacctgga
2401 caagacgtgg gttcggtatc aggaatgtga ctcgcgcagc aacgcccctg cgacccttac
2461 ttttgagaac atggccgggg tcttcatgct ggtagctggg gcatcgtgg ccgggatctt
2521 cctgattttc atcgagattg cctacaagcg gcacaaggat gctcgccgga gcagatgca
2581 gctggccttt gccgccgtta acgtgtggcg gaagaacctg caggatagaa agagtggtag
2641 agcagagcct gaccctaaaa agaaagccac atttagggct atcacctcca ccctggcttc
2701 cagcttcaag aggcgtaggt cctccaaaga cacgagcacc ggggtggac gcggcgcttt
2761 gcaaaaccaa aaagacacag tgctgccgcg acgcgctatt gagagggagg agggccagct
2821 gcagctgtgt tcccgtcata gggagagctc aggcctcatg ggcccagctt tcttgtac
```

FIG. 148

Hepatitis B virus L form of S glycoprotein (Type 3 protein)

MGLSWTVPLEWGKNLSTSNPLGFLPDHQLDPAFRANTNNPDWDF

NPKKDPWPEANKVGVGAYGPGFTPPHGGLLGWSPQSQGTLTTLPADPPPASTNRQSGR

QPTPISPPLRDSHPQAMQWNSTAFHQALQNPKVRGLYFPAGGSSSGIVNPVPTIASHI

SSIFSRIGDPAPNMENITSGFLGPLLVLQAGFFLLTRILTIPQSLDSWWTSLNFLGGV

PVCPGLNSQSPTSNHSPISCPPTCPGYRWMCLRRFIIFLFILLLCLIFLLVLLDYQGM

LPVCPLIPGSSTTSTGPCKTCTTPAQGNSMYPSCCCTKPSDGNCTCIPIPSSWAFAKY

LWEWASVRFSWLSLLVPFVQWFVGLSPTVWLSAIWMMWYWGPNLYNILSPFIPLLPIF

FCLWVYI

FIG. 149

Hepatitis B virus L form of S glycoprotein (Type 3 protein)

```
           atgggget ttcttggacg gtccctctcg agtggggaaa gaacctttcc accagcaatc
2941 ctctaggatt ccttcccgat caccagttgg acccagcatt cagagcaaat accaacaatc
3001 cagattggga cttcaatccc aaaaaggacc cttggccaga ggccaacaag gtaggagttg
3061 gagcctatgg acccgggttc acccctccac acggaggcct tttggggtgg agccctcagt
3121 ctcagggcac actaacaact ttgccagcag atccgcctcc tgcctccacc aatcgtcagt
3181 cagggaggca gcctactccc atctctccac cactaagaga cagtcatcct caggccatgc
3241 agtggaa
```

FIG. 150

Prion Protein (Type 3 protein)

MANLGCWMLVLFVATWSDLGLCKKRPKPGGWNTGGSRYPGQGSP

GGNRYPPQGGGGWGQPHGGGWGQPHGGGWGQPHGGGWGQGGGTHSQWNKP

SKPKTNMKHMAGAAAAGAVVGGLGGYMLGSAMSRPIIHFGSDYEDRYYRENMHRYPNQ

VYYRPMDEYSNQNNFVHDCVNITIKQHTVTTTTKGENFTETDVKMMERVVEQMCITQY

ERESQAYYQRGSSMVLFSSPPVILLISFLIFLIVG

FIG. 151

Prion Protein (Type 3 protein)

```
   1 attaaagatg attttacag tcaatgagcc acgtcaggga gcgatggcac ccgcaggcgg
  61 tatcaactga tgcaagtgtt caagcgaatc tcaactcgtt ttttccggtg actcattccc
 121 ggccctgctt ggcagcgctg cacccttaa cttaaacctc ggccggccgc ccgccggggg
 181 cacagagtgt gcgccgggcc gcgcggcaat tggtccccgc gccgacctcc gcccgcgagc
 241 gccgccgctt cccttccccg ccccgcgtcc ctcccctcg gccccgcgcg tcgcctgtcc
 301 tccgagccag tcgctgacag ccgcggcgcc gcgagcttct cctctcctca cgaccgagtc
 361 attatggcga accttggctg ctggatgctg gttctctttg tggccacatg gagtgacctg
 421 ggcctctgca agaagcgccc gaagcctgga ggatggaaca ctggggggcag ccgatacccg
 481 gggcagggca gccctgaggg caaccgctac ccacctcagg gcggtggtgg ctgggggcag
 541 cctcatggtg gtggctgggg gcagcctcat ggtggtggct ggggggcagcc ccatggtggt
 601 ggctggggac agcctcatgg tggtggctgg ggtcaaggag gtggcaccca cagtcagtgg
 661 aacaagccga gtaagccaaa aaccaacatg aagcacatgg ctggtgctgc agcagctggg
 721 gcagtggtgg gggcccttgg cggctacatg ctgggaagtg ccatgagcag gcccatcata
 781 catttcggca gtgactatga ggaccgttac tatcgtgaaa acatgcaccg ttaccccaac
 841 caagtgtact acaggcccat ggatgagtac agcaaccaga caactttgt gcacgactgc
 901 gtcaatatca caatcaagca gcacacggtc accacaacca caaggggga aacttcacc
 961 gagaccgacg ttaagatgat ggagcgcgtg gttgagcaga tgtgtatcac ccagtacgag
1021 agggaatctc aggcctatta ccagagagga tcgagcatgg tcctcttctc ctctccacct
1081 gtgatcctcc tgatctcttt cctcatcttc ctgatagtgg gatgaggaag gtcttcctgt
1141 tttcaccatc tttctaatct ttttccagct tgagggaggc ggtatccacc tgcagcccttt
1201 ttagtggtgg tgtctcactc tttcttctct ctttgtcccg gataggctaa tcaataccct
1261 tggcactgat gggcactgga aaacatagag tagacctgag atgctggtca agccccctttt
1321 gattgagttc atcatgagcc gttgctaatg ccaggccagt aaaagtataa cagcaaataa
1381 ccattggtta atctggactt attttggac ttagtgcaac aggttgaggc taaaacaaat
1441 ctcagaacag tctgaaatac ctttgcctgg atacctctgg ctccttcagc agctagagct
1501 cagtatacta atgccctatc ttagtagaga tttcatagct atttagagat attttccatt
1561 ttaagaaaac ccgacaacat ttctgccagg tttgttagga ggccacatga tacttattca
1621 aaaaaatcct agagattctt agctcttggg atgcaggctc agcccgctgg agcatgagct
1681 ctgtgtgtac cgagaactgg ggtgatgttt tactttcac agtatgggct acacagcagc
1741 tgttcaacaa gagtaaatat tgtcacaaca ctgaacctct ggctagagga catattcaca
1801 gtgaacataa ctgtaacata tatgaaaggc ttctgggact tgaaatcaaa tgtttgggaa
1861 tggtgccctt ggaggcaacc tcccatttta gatgtttaaa ggaccctata tgtggcattc
1921 ctttcttaa actataggta attaaggcag ctgaaaagta aattgccttc tagacactga
1981 aggcaaatct cctttgtcca tttacctgga aaccagaatg attttgacat acaggagagc
2041 tgcagttgtg aaagcaccat catcatagag gatgatgtaa ttaaaaaatg gtcagtgtgc
2101 aaagaaaaga actgcttgca tttctttatt tctgtctcat aattgtcaaa aaccagaatt
2161 aggtcaagtt catagtttct gtaattggct tttgaatcaa agaatagggg acaatctaa
2221 aaaatatctt aggttggaga tgacagaaat atgattgatt tgaagtggaa aagaaattc
2281 tgttaatgtt aattaaagta aaattattcc ctgaattgtt tgatattgtc acctagcaga
2341 tatgtattac ttttctgcaa tgttattatt ggcttgcact ttgtgagtat tctatgtaaa
2401 aatatatatg tatataaaat atatattgca taggacagac ttaggagttt tgtttagagc
2461 agttaacatc tgaagtgtct aatgcattaa cttttgtaag gtactgaata cttaatatgt
2521 gggaaaccct tttgcgtggt ccttaggctt acaatgtgca ctgaatcgtt tcatgtaaga
2581 atccaaagtg gacaccatta acaggtcttt gaaatatgca tgtactttat attttctata
2641 tttgtaactt tgcatgttct tgttttgtta tataaaaaaa ttgtaaatgt ttaatatctg
2701 actgaaatta aacgagcgaa gatgagcacc aaaaaaaaaa aaaaaa
```

FIG. 152

Hepatitis A Virus VP1 (Soluble protein)

```
  1 sggfsttvst eqnvpdpqvg ittmkdlkgk ankgkmdvsg vqapvgaitt iedpvlakkv
 61 petfpelkpg esrhtsdhms iykfmgrshf lctftfnsnn keytfpitls stsnpphglp
121 stlrwffnlf qlyrgpldlt iiitgatdvd gmawftpvgl avdtprveke sapsidykta
181 lgavrfhsrr tgniqirlsw ysylyavsga ldglgdktds tfglvsiqia nynhsdeyls
241 fscylsvteq sefyfprapl nsnalls
```

FIG. 153

Hepatitis A Virus VP1 (Soluble protein)

```
  1 tctgggggtt tttcaacaac agtttctaca gagcagaatg ttccagatcc ccaagttggt
 61 ataacaacca tgaaggattt aaaaggcaaa gctaataagg gaaaaatgga tgtttcagga
121 gtgcaagcac ctgtgggagc tatcacaaca attgaggatc ctgttttagc aaagaaagta
181 cctgagacat tccctgaatt gaaacctgga gagtccaggc atacatcaga tcatatgtct
241 atttacaagt ttatgggaag gtctcatttt ttgtgcactt ttacttttaa ttcaaacaat
301 aaagagtaca catttcctat aaccttgtct tcaacctcca atcctcctca tggtttacca
361 tcaacattga ggtggttttt caatttgttt caattgtata gaggaccttt agatctgaca
421 attatcatca ctggagcaac tgatgtagat ggcatggctt ggtttacacc agtaggtctt
481 gccgttgata ctcctcgggt agagaaggag tcagctccgt ctattgacta caaaactgct
541 cttggagctg tcagatttca ctcaaggaga acagggaaca ttcagattag gttatcatgg
601 tattcttatt tatatgctgt gtctggagca ctggatggtt tgggagataa gacagattct
661 acattcggat tggtttctat tcagattgca aattataatc attctgatga atatttgtct
721 tttagttgct atttgtctgt cacagaacaa tcagaatttt attttcccag agctccattg
781 aattcaaatg ccttgttatc
```

FIG. 154

Human Parvovirus VP  (B19 Virus) (Soluble protein)

```
  1 ggsnpvksmw segatfsans vtctfsrqfl ipydpehhyk vfspaassch nasgkeakvc
 61 tispimgyst pwryldfnal nlffsplefq hlienygsia pdaltvtise iavkdvtdkt
121 gggvqvtdst tgrlcmlvdh eyqypyvlgq gqdtlapelp iwvyfppqya yltvgdvntq
181 gisgdskkla seesafyvle hssfqllgtg gtatmsykfp pvppenlegc sqhfyemynp
241 lygsrlgvpd tlggdpkfrs lthedhaiqp qnfmpgplvn svstkegdss ntgagkaltg
301 lstgtsqntr islrpgpvsq pyhhwdtdky vtginasshg qttygnaedk eyqqgvgrfp
361 nekeqlkqlq glnmhtyfpn kgtqqytdqi erplmvgsvw nrralhyesq lwskipnldd
421 sfktqfaalg gwglhqpppq iflkilpqsg piggiksmgi ttlvqyavgi mtvtmtfklg
481 pr
```

FIG. 155

Human Parvovirus VP (B19 Virus) (Soluble protein)

```
   1 gggggcagta atcctgttaa aagcatgtgg agtgaggggg ccacttttag tgccaactct
  61 gtaacttgta cattttccag acagttttta attccatatg acccagagca ccattataag
 121 gtattttctc ccgcagcaag tagctgccac aatgccagtg gaaaggaggc aaaggtttgc
 181 accattagtc ccataatggg gtactcaacc ccatggagat atttagattt taatgcatta
 241 aatttatttt tttcaccttt agagtttcag cacttaattg aaaattatgg cagtatagct
 301 cctgatgctt taactgtaac catatcagaa attgctgtta aggacgttac agacaaaact
 361 ggagggggggg tacaggttac tgacagcact acagggcgcc tatgcatgtt agtggaccat
 421 gaatatcagt acccatatgt gttagggcaa ggtcaggata ctttagcccc agaacttcct
 481 atttgggtat actttccccc tcaatatgct tacttaacag taggagatgt taacacacaa
 541 ggaatttctg gagacagcaa aaaattagca agtgaagaat cagcatttta tgttttggaa
 601 cacagttctt ttcagcttct aggtacagga ggtacagcaa ctatgtctta taagtttcct
 661 ccagtgcccc cagaaaattt agagggctgc agtcaacact tttatgaaat gtacaatccc
 721 ttatacggat cccgcttagg ggttcctgac acattaggag gtgacccaaa atttagatct
 781 ttaacacatg aagaccatgc aattcagccc caaaacttca tgccagggcc actagtaaac
 841 tcagtgtcta caaaggaggg agacagctct aatactggag ctggaaaagc cttaacaggc
 901 cttagcacag gtacctctca aaacactaga atatccctac gccctgggcc agtgtctcag
 961 ccataccacc actgggacac agataaatat gtcacaggaa taatgccag ttctcatggt
1021 cagaccactt atggtaacgc tgaagacaaa gagtatcagc aaggagtggg tagatttcca
1081 aatgaaaaag agcagctaaa acagttacag ggtttaaaca tgcacaccta ctttcccaat
1141 aaaggaaccc agcaatatac agatcaaatt gagcgacccc taatggtggg ttctgtatgg
1201 aacagaagag cccttcacta tgaaagccag ctgtggagta aaattccaaa tttagatgac
1261 agttttaaaa ctcagtttgc agccttagga ggatggggtt tgcatcagcc acctcctcaa
1321 atattttaa aaatattacc acaaagtggg ccaattggag gtattaaatc aatgggaatt
1381 actaccttag ttcagtatgc tgtgggaatt atgacagtaa ctatgacatt taaattgggg
1441 ccccg
```

FIG. 156

Norovirus VP1 (Soluble protein)

```
  1 mkmasndaap sndgaaglvp eintetlple pvagaalaaa vtgqsniidp wirtnfvqap
 61 ngeftvsprn spgevllnle lgpdlnpyla hlsrmyngya ggvevqvlla gnaftagkil
121 faavppnfpv eflspaqitm lphlivdvrt lepimiplpd vrntffhynn rpsermrlva
181 mlytplrsng sgddvftvsc rvltrptpdf eftylvppsv esktkpfslp iltiseltns
241 rfpapidslf taqnnnlnvq cqngrctldg elqgttqllp tgicafrgki sadvqnshqd
301 rwhmqltnln gtpfdptddv paplgtpdft gllfgvasqr nvggtgnntt rahevviatt
361 stqfvpklgs infgesedf qvgpptkftp vgikietghs frqwdppnys galtlnmnla
421 ppvapnfpge qllffrsnvp caggvsegii dcllpqewiq hfyqesapsq sdvaliryvn
481 pdtgrtlfea klhrtgyitv ahsgdyplvv psngyfrfds winqfyslap mgtgngrrrv
541 q
```

FIG. 157

Norovirus VP1 (Soluble protein)

```
   1 gtgaatgaag atggcgtcga atgacgccgc tccatctaat gatggtgctg cgggcctcgt
  61 cccagagatc aacaccgaga cccttcccct ggaaccagtg gctggtgcag ctcttgctgc
 121 ggctgtcact ggtcaaagta atataattga tccctggatt agaacaaatt ttgtgcaagc
 181 acccaatggg gagttcactg tttcacctag gaattcccca ggagaagtcc tcctaaattt
 241 agaattaggt cctgatttaa atccttattt ggcacactta tctagaatgt ataatgggta
 301 tgctggtgga gtggaggtcc aggttctcct agcagggaac gcgttcaccg ctggaaagat
 361 cctcttcgct gccgtaccgc caaatttccc agttgaattc ttaagtcctg cccaaatcac
 421 tatgctccca catttgatag ttgacgtcag gacccttgag ccaattatga taccctccc
 481 cgacgtgaga aacaccttct tccattacaa taataggccc tctgagcgta tgcgtttggt
 541 ggccatgttg tacacacccc tgagatccaa cggttcaggt gatgatgtct tcacagtctc
 601 atgcagagtg ctaactagac ccactccaga ttttgaattt acctacctag ttccaccctc
 661 agtagagtct aagacaaagc ctttctctct tcccatctta accatttctg aattgactaa
 721 ttcaaggttt ccagcaccca ttgattcatt gtttactgcc caaataaca atcttaatgt
 781 ccaatgtcag aatggtcggt gcacactaga tggtgagttg cagggaacca cccagctgct
 841 cccaactgga atatgtgcct tcagagggaa aatatcagca gatgtgcaaa acagtcacca
 901 agacaggtgg cacatgcagt tgacaaatct caatggaacc ccatttgacc aacagatga
 961 tgtcccagct ccgcttggca cccctgactt cacaggtcta ctgtttgggg ttgcaagtca
1021 aagaaacgtt ggtggaacag taacaacac taccagggcc cacgaggtag tgatagcaac
1081 aactagcaca caatttgttc caaaattggg ttctattaat tttgggagtg aaagtgaaga
1141 ttttcaagtg ggcccaccaa ccaaattcac accagttgga atcaaaattg aaaccgggca
1201 ctctttcaga caatgggacc cacctaacta ttctggagca ctgaccctca acatgaacct
1261 tgccccacct gttgcccaa atttcccagg tgagcagctg ctcttcttta gatcaaatgt
1321 tccttgtgct ggtggtgtca gtgagggtat cattgactgc ctactgcctc aagagtggat
1381 acaacatttc taccaggaat ccgctccatc ccaatcagat gtggcactga tcagatatgt
1441 caaccctgac acgggccgca ctctctttga ggcaaaactc cacaggactg gttacattac
1501 tgttgctcac tctggtgact atcctcttgt tgttccttcc aatggctact cagatttga
1561 ttcttggata aatcaatttt actcactcgc ccccatggga actgggaatg ggcgcaggag
1621 agtgcagtaa tggcaggagc ttttatagca ggtcttgcag gtgacatgct cacctctgct
1681 gtaggctcac tggcgaatgc cggagcaaat gccataacac agaaaattga ctttgaaaac
1741 aacaaacaac tccaaacggc ctcctttcaa catgacaaag atatgctccg cgcacaagtg
1801 gatgcaacca agcagctgca ggcagaaatg attgccatca acagggggat cttgaccgct
1861 ggcggcttct cccctgctga cgcagcgaga ggggctgtag gagcacccat gaccaaggtg
1921 cttgactggt ctggcacacg ctattggca ccaaattcta ccaaaacaac aagttactcc
1981 gggcagttca catcagcgcc tgtgcacaca ccaaatttca cagcaaacc caggcctcct
2041 gccaaaaccc agccttcttc ttcttcttct ggtagtgttt atagtctttc aacccaatca
2101 acttcgctcc ctggaccctc ttcttcgggt tcatctgttt cttctgtctc aacacaatca
2161 acaaaattga gttcagtttc ttctatgagt agaacagcag attgggtcaa tcaacaaagg
2221 agcctcagcc cttacatgag cggggccctt aatatttctc atgtgacacc tccatcaagc
2281 agggcttcaa gttcgggaac agtgtcaact gtacccaaag aagttttgga ctcctggaca
2341 tctgcattca acacacgcag acagccgctc ttcgcacacc tcagagtgag ggggagtca
2401 cgtgtttagt gaaagaatc aattagtttt aattaggtta aattttaatt ggatctttt
```

FIG. 158

Human Rhinovirus VP1 (Soluble protein)

```
  1 npvedyidkv vdtvlqvpnt qpsgpqhsiq psalgameig assttipgdl ietryvinsn
 61 tnsealienf mgrsalwaki qvangfakwd infqehaqvr kkfemftyar fdmevtvvtn
121 ntglvqimfv ppgidapdsi dsrlwdsasn psvfyqpksg fprftipftg lgsayymfyd
181 gydvprnksn avygitstnd mgtlcframe dtnehsirvf vkpkhtiawi prppratqyt
241 hkfstnyhvk kpddttglli qkhfinhrtd ikta
```

FIG. 159

Human Rhinovirus VP1 (Soluble protein)

```
                       tcaaaaccca gttgaggact acatagacaa ggtggtcgac
2341 actgtactac aggtcccaaa cacccaaccc agtggtccac aacacagtat tcaaccaagt
2401 gctttgggcg ctatggaaat tggggcatct tcaaccacca taccaggtga tctcatagag
2461 actaggtatg taatcaactc aaatactaac agtgaagccc taattgagaa cttcatgggc
2521 cgctcagctc tttgggccaa gatccaggtg gcgaatggtt ttgcaaaatg ggatataaac
2581 ttccaagagc atgcacaagt cagaaagaaa tttgaaatgt ttacatatgc tagatttgac
2641 atggaagtta ctgttgtcac caacaacaca ggtttggtac aaatcatgtt tgtaccacct
2701 ggtatagatg caccagatag tattgactcc cgtctatggg attctgcctc caacccgagt
2761 gttttctatc aaccaaaatc aggttttcct aggtttacta ttccattcac tggattgggt
2821 tcagcttatt atatgtttta tgatggttat gatgtcccca gaaataaaag taatgctgtg
2881 tatggtatca catctacaaa tgatatgggg acactttgct tcagagctat ggaagacacc
2941 aatgaacaca gcattagagt ctttgtaaag cctaaacata ccatagcatg gattccacga
3001 ccacctcgtg ccacccaata cacccacaaa ttcagcacaa actaccatgt taagaaacca
3061 gatgacacta ctggactact aatacagaaa cactttatta accacaggac
```

FIG. 160

Human Rotavirus (strain K8) VP4 (Soluble protein)

MASLIYRQLLSNSYVTNISDEVNEIGTKKTTNVTVNPGPFAQTG

YAPVDWGHGELPDSTLVQPTLDGPYQPTSLNLPVDYWMLIAPTREGKVAEGTNTTDRW

FACVLVEPNVQNTQRQYVLDGQNVQLHVSNDSSTSWKFILFIKLTPYGTYTQYSTLST

PHKLCAWMKRDNRVYWYQGATPNASESYYLTINNDNSNVSSDAEFYLIPQSQTAMCTQ

YINNGLPPIQNTRNIVPVNITSRQIKDVRAQMNEDIVISKTSLWKEMQYNRDIIIRFK

FANSIIKSGGLGYKWSEISFKPMNYQYTYTRDEEEVTAHTTCSVNGVNDFNYNGGTLP

TDFAISRFEVIKENSYVYVDYWDDSQAFRNMVYVRSLAANLNDVVCSGGSYSFALPVG

NHPVMSGGAVTLTSAGVTLSTQYTDYVSLNSLQFRFRLAVSEPSFSISRTRMSGIYGL

PAVNPNNSAEYYEIAGRFSLISLVPTNDDYQTPIANSVTVRQDLERQLGELREEFNSL

SQEIAVSQLIDLATLPLDMFSMFSGIKSTVEAVKSMTTNVMKRFKTSSLANAISDLTS

NMSEAASSVRLTSVRSVGTITLPRARVSLQVGDDLRSMQDVSTQVSNVSRNLRLKEFT

TQTDTLSFDDISAAVLKTKLDKSTQISQQTMPDIIAESSEKFIPKRSYRIVDEDIRFE

TGIDGTFYAYKVDTFNEIPFDMERFNKLITDSPVLSAIIDFKTLKNLNDNYGITKKQA

MELLHSNPKTLKEFINNNNPIIRNRIENLISQCRL

FIG. 161

Human Rotavirus (strain K8) VP4 (Soluble protein)

```
   1 ggctataaaa tggcttcttt aatttataga cagttattat caaactcata tgttacaaac
  61 atctctgacg aagttaatga aattggaact aaaaaaacaa ctaacgttac tgttaatcca
 121 gggccattcg cacaaacggg atatgcgcct gttgactggg gacatggtga attgcctgat
 181 tctacattgg tgcagccaac tcttgatggt ccataccaac ccacctcact caacttacca
 241 gttgattatt ggatgttaat tgcgcctact agagaaggaa aagttgctga aggtacaaat
 301 acgactgaca gatggttcgc ttgtgtacta gttgaaccaa atgtgcaaaa tacacaaaga
 361 caatacgtat tagatgggca aaatgtccaa ttgcatgtct caaacgattc aagtacttcg
 421 tggaaattta tattattcat taaattgacg ccttatggaa cgtacactca atattcaaca
 481 ttatcaacgc cgcataagtt gtgcgcgtgg atgaaaagag ataacagagt gtactggtat
 541 caaggagcga caccgaacgc atcagagagc tattacttga ccataaacaa tgataacagc
 601 aacgtttcaa gtgacgctga attttattta ataccgcaat cgcagaccgc tatgtgtaca
 661 caatatataa acaatggttt accaccaatt cagaatacca ggaatattgt accagtaaat
 721 attacatcta gacagattaa agacgtaaga gctcagatga atgaagacat agtaatatca
 781 aaaacctcgt tatggaaaga aatgcaatat aatagagata taatcattag atttaaattt
 841 gctaattcaa taatcaaatc aggtggacta ggttataagt ggtcggaaat atcatttaag
 901 cccatgaact atcaatatac gtatacgaga gatgaagaag aagtaacagc acatacaaca
 961 tgttcagtga atggtgtcaa tgattttaat tataatggag gtacgttgcc tactgatttt
1021 gcaatatcga gatttgaggt cataaaggaa aattcttatg tatatgtaga ttattgggat
1081 gattcacaag catttagaaa tatggtatat gtgaggtcgt tagctgcaaa tttgaatgat
1141 gtagtatgca gtggaggttc ttacagtttt gcgttacctg taggcaatca tccggtgatg
1201 agtggtggtg cagtgacctt aacatctgct ggcgtaacac tatcaaccca gtatacagat
1261 tatgtatcat taaattcatt gcaattcaga ttcagattgg cggtgagcga accatcattt
1321 tccatctcgc gaactagaat gagtggcata tatggattac cagctgtaaa tccaaataat
1381 agcgcagaat attatgagat agctggtaga ttctcactca tatcactagt accaacaaat
1441 gatgactatc aaacgccaat cgctaattca gttaccgtaa gacaagattt agagagacaa
1501 ttaggcgagt taagagaaga atttaattcg ttgtcacaag aaatagctgt ttcccaactt
1561 atagatctag caacattacc gcttgatatg ttctcaatgt tctctggaat aaaatcaacg
1621 gtagaggcag taaaatctat gactacgaat gtgatgaaaa gatttaaaac atcaagttta
1681 gcaaacgcca tatctgattt aacaagtaat atgtcggaag cggcatcatc tgtaagattg
1741 acgtcagtga gatcggtggg cactattaca ttgccaagag ctagggtttc attgcaagtg
1801 ggcgatgact tgaggtccat gcaagacgta tcaacacaag tgtcaaatgt gagtagaaat
1861 ttaagattga aagagttcac gacgcaaact gatactttaa gctttgatga catctctgca
1921 gctgtattga agacgaaact agataaatcg acgcaaattt cacaacaaac aatgccagat
1981 attatagctg agtcatctga gaagtttata ccgaagagat cgtatagaat agttgatgag
2041 gatattcgat tcgaaactgg aattgacgga acgttttatg cttacaaagt cgatacattt
2101 aatgaaattc cgtttgatat ggaacgattt aataaattaa taacagattc accagtttta
2161 tcagcaataa tagactttaa gacgttaaag aacttaaacg acaattatgg aataacaaag
2221 aaacaagcca tggaactatt acattcaaat ccaaagacat taaaagagtt tataaataat
2281 aataatccaa taattagaaa tagaatcgaa aacttaatat cgcagtgtag gttgtagctg
2341 tctattttaa gatgtgacc
```

|          | CT TM     | Ectodomain |              |
|----------|-----------|------------|--------------|
|          |           | ← TM  junction ↓  Ectodomain → | |
| NDV HN   | ---ALAYS  | MEASTP---  | SEQ ID NO. 376 |
| Influenza NA | ---ILITT | VTLHFK---  | SEQ ID NO. 377 |
| HN/NA chimera | ---ALAYS | VTLHFK--- | SEQ ID NO. 378 |

Ectodomains

NDV F

Influenza HA

HA/F chimera

← TM domain | CT domain →
junction

NDV F           --CYLMY  KQKAQQK---
Influenza HA    --LGFIMY ACQKGNI---
HA/F chimera    --LGFIMY KQKAQQK---

Fig. 177

Fujian Srain of Influenza HA (Type 1 protein)

MKTIIALSYILCLVFAQKLPGNDNSTATLCLGHHAVPNGTIVKTITNDQIEVTNATELVQS
SSTGGICDSPHQILDGENCTLIDALLGDPQCDGFQNKKWDLFVERSKAYSNCYPYDVPD
YASLRSLVASSGTLEFNNESFNWTGVTQNGTSSACKRRSNKSFFSRLNWLTHLKYKYPA
LNVTMPNNEKFDKLYIWGVLHPGTDSDQISLYAQASGRITVSTKRSQQTVIPNIGSRPRV
RDVSSRISIYWTIVKPGDILLINSTGNLIAPRGYFKIRSGKSSIMRSDAPIGKCNSECITPNG
SIPNDKPFQNVNRITYGACPRYIKQNTLKLATGMRNVPEKQTRGIFGAIAGFIENGWEGM
VDGWYGFRHQNSEGTGQAADLKSTQAAINQINGKLNRLIGKTNEKFHQIEKEFSEVEGR
IQDLEKYVEDTKIDLWSYNAELLVALENQHTIDLTDSEMNKLFERTKKQLRENAEDMG
NGCFKIYHKCDNACIGSIRNGTYDHDVYRDEALNNRFQIKGVELKSGYKDWILWISFAIS
CFLLCVALLGFIMWACQKGNIRCNICI

FIG. 179

Fujian Srain of Influenza HA (Type 1 protein)

ATGAAGACTATCATTGCTTTGAGCTACATTCTATGTCTGGTTTTCGCTCAAAAACTTC
CCGGAAATGACAACAGCACGGCAACGCTGTGCCTTGGGCACCATGCAGTACCAAAC
GGAACGATAGTGAAAACAATCACGAATGACCAAATTGAAGTTACTAATGCTACTGA
GCTGGTTCAGAGTTCCTCAACAGGTGGAATATGCGACAGTCCTCATCAGATCCTTGA
TGGAGAAAACTGCACACTAATAGATGCTCTATTGGGAGACCCTCAGTGTGATGGCTT
CCAAAATAAGAAATGGGACCTTTTTGTTGAACGCAGCAAAGCCTACAGCAACTGTT
ACCCTTATGATGTGCCGGATTATGCCTCCCTTAGGTCACTAGTTGCCTCATCCGGCAC
ACTGGAGTTTAACAATGAAAGCTTCAATTGGACTGGAGTCACTCAGAATGGAACAA
GCTCTGCTTGCAAAAGGAGATCTAATAAAAGTTTCTTTAGTAGATTGAATTGGTTGA
CCCATTTAAAATACAAATACCCAGCATTGAACGTGACTATGCCAAACAATGAAAAA
TTTGACAAATTGTACATTTGGGGGGTTCTCCACCCGGGTACGGACAGTGACCAAATC
AGCCTATATGCTCAAGCATCAGGAAGAATCACAGTCTCTACCAAAAGAAGCCAACA
AACTGTAATCCCGAATATCGGATCTAGACCCAGGGTAAGGGATGTCTCCAGCAGAA
TAAGCATCTATTGGACAATAGTAAAACCGGGAGACATACTTTTGATTAACAGCACA
GGGAATCTAATTGCTCCTAGGGGTTACTTCAAAATACGAAGTGGGAAAAGCTCAAT
AATGAGATCAGATGCACCCATTGGCAAATGCAATTCTGAATGCATCACTCCAAATGG
AAGCATTCCCAATGACAAACCATTTCAAAATGTAAACAGGATCACATATGGGGCCT
GTCCCAGATATATTAAGCAAAACACTCTGAAATTGGCAACAGGGATGCGAAATGTA
CCAGAGAAACAAACTAGAGGCATATTTGGCGCAATCGCGGGTTTCATAGAAAATGG
TTGGGAGGGAATGGTGGACGGTTGGTACGGTTTCAGGCATCAAAATTCTGAGGGCA
CAGGACAAGCAGCAGATCTCAAAAGCACTCAAGCAGCAATCAACCAAATCAATGGG
AAACTGAATAGGTTAATCGGGAAAACAAACGAGAAATTCCATCAGATTGAAAAAGA
ATTCTCAGAAGTAGAAGGGAGAATTCAGGACCTCGAGAAATATGTTGAGGACACTA
AAATAGATCTCTGGTCATACAACGCGGAGCTTCTTGTTGCCCTGGAGAACCAACATA
CAATTGATCTAACTGACTCAGAAATGAACAAACTGTTTGAAAGAACAAAGAAGCAA
CTGAGGGAAAATGCTGAGGATATGGGCAATGGTTGTTTCAAAATATACCACAAATG
TGACAATGCCTGCATAGGGTCAATCAGAAATGGAACTTATGACCATGATGTATACA
GAGATGAAGCATTAAACAACCGGTTCCAGATCAAAGGTGTTGAGCTGAAGTCAGGA
TACAAAGATTGGATCCTATGGATTTCCTTTGCCATATCATGTTTTTGCTTTGTGTTG
CTTTGTTGGGGTTCATCATGTGGGCCTGCCAAAAAGGCAACATTAGGTGCAACATTT
GCATTTGA

FIG. 180

Fujian Influenza NA (Type 2 protein)

MNPNQKIITIGSVSLTISTICFFMQIAILITTVTLHFKQYEFNSPPNNQVMLCEPTIIERNITEI
VYLTNTTIEKEICPKLAEYRNWSKPQCNITGFAPFSKDNSIRLSAGGDIWVTREPYVSCDP
DKCYQFALGQGTTLNNVHSNDTVHDRTPYRTLLMNELGVPFHLGTKQVCIAWSSSSCH
DGKAWLHVCVTGDDENATASFIYNGRLVDSIVSWSKKILRTQESECVCINGTCTVVMTD
GSASGKADTKILFIEEGKIVHTSTLSGSAQHVEECSCYPRYPGVRCVCRDNWKGSNRPIV
DINIKDYSIVSSYVCSGLVGDTPRKNDSSSSHCLDPNNEEGGHGVKGWAFDDGNDVW
MGRTISEKLRSGYETFKVIEGWSNPNSKLQINRQVIVDRGNRSGYSGIFSVEGKSCINRCF
YVELIRGRKQETEVLWTSNSIVVFCGTSGTYGTGSWPDGADINLMPI

FIG. 181

Fujian Influenza NA (Type 2 protein)

ATGAATCCAAATCAAAAGATAATAACGATTGGCTCTGTTTCTCTCACCATTTCCACA
ATATGCTTCTTCATGCAAATTGCCATCCTGATAACTACTGTAACATTGCATTTCAAGC
AATATGAATTCAACTCCCCCCCAAACAACCAAGTGATGCTGTGTGAACCAACAATA
ATAGAAAGAAACATAACAGAGATAGTGTATCTGACCAACACCACCATAGAGAAGGA
AATATGCCCCAAACTAGCAGAATACAGAAATTGGTCAAAGCCGCAATGTAACATTA
CAGGATTTGCACCTTTTTCTAAGGACAATTCGATTCGGCTTTCCGCTGGTGGGGACA
TCTGGGTGACAAGAGAACCTTATGTGTCATGCGATCCTGACAAGTGTTATCAATTTG
CCCTTGGACAGGGAACAACACTAAACAACGTGCATTCAAATGACACAGTACATGAT
AGGACCCCTTATCGGACCCTATTGATGAATGAGTTGGGTGTTCCATTTCATCTGGGG
ACCAAGCAAGTGTGCATAGCATGGTCCAGCTCAAGTTGTCACGATGGAAAGGCATG
GCTGCATGTTTGTGTAACGGGGGATGATGAAAATGCAACTGCTAGCTTCATTTACAA
TGGGAGGCTTGTAGATAGTATTGTTTCATGGTCCAAAAAAATCCTCAGGACCCAGGA
GTCAGAATGCGTTTGTATCAATGGAACTTGTACAGTAGTAATGACTGATGGGAGTGC
TTCAGGAAAAGCTGATACTAAAATACTATTCATTGAGGAGGGGAAAATCGTTCATA
CTAGCACATTGTCAGGAAGTGCTCAGCATGTCGAGGAGTGCTCCTGTTATCCTCGAT
ATCCTGGTGTCAGATGTGTCTGCAGAGACAACTGGAAAGGCTCCAATAGGCCCATC
GTAGATATAAACATAAAGGATTATAGCATTGTTTCCAGTTATGTGTGCTCAGGACTT
GTTGGAGACACACCCAGAAAAAACGACAGCTCCAGCAGTAGCCATTGCTTGGATCC
AAACAATGAGGAAGGTGGTCATGGAGTGAAAGGCTGGGCCTTTGATGATGGAAATG
ACGTGTGGATGGGAAGAACGATCAGCGAGAAGTTACGCTCAGGATATGAAACCTTC
AAAGTCATTGAAGGCTGGTCCAACCCTAACTCCAAATTGCAGATAAATAGGCAAGT
CATAGTTGACAGAGGTAATAGGTCCGGTTATTCTGGTATTTTCTCTGTTGAAGGCAA
AAGCTGCATCAATCGGTGCTTTTATGTGGAGTTGATAAGGGGAAGAAAACAAGAAA
CTGAAGTCTTGTGGACCTCAAACAGTATTGTTGTTTTGTGGCACCTCAGGTACAT
ATGGAACAGGCTCATGGCCTGATGGGGCGGACATCAATCTCATGCCTATATAA

FIG. 182

M protein from Newcastle Disease Virus (NDV) strain Hertz
GenBank Accession Number  AF431744

MDSSRTIGLYFDSTLPSSNLLAFPIVLQDTGDGKKQITPQYRIQ

RLDSWTDSKEDSVFITTYGFIFQVGSEEVTVGTINDNPKHELLSSAMLCLGSVPNDGD

LVELARACLTMVVTCKKSATNTERMVFSVVQAPRVLQSCMVVANRYSSVNAVKHVKVP

EKIPGSGTLEYKVNFVSLTVVPKKDVYRIPTAALKVSGSSLYNLALNVTIDVEVDPKS

PLVKSLSKSDSGYYANLFLHIGLMSTVDKKGKKVTFDKLEKKIRRLDLSVGLSDVLGP

SVLVKARGVRTRLLAPFFSSSGTACYPIANASPQVAKILWSQTARLRSVKVIIQAGTQ

RAVAVTADHEVTSTKIEKRHTIAKYNPFKKSAASLRLQSARFPESP

FIG. 183

M protein from Newcastle Disease Virus (NDV) strain Hertz
GenBank Accession Number  AF431744

```
                                                              a tggactcatc
3301 caggacaatc gggctgtact tcgattccac ccttccttcc agcaacctgc tagcattccc
3361 gatcgtccta caagacacag gagatgggaa gaagcaaatc accccgcaat ataggatcca
3421 gcgtcttgac tcgtggacag acagcaaaga agattcggta tttatcacca cttatggatt
3481 catcttccag gttgggagtg aggaagtcac tgtcggcacg atcaatgata atcccaagca
3541 cgagttactt tcctctgcga tgctctgcct aggaagtgtc ccgaatgacg agatcttgt
3601 tgagctggcg agggcctgcc ttactatggt ggtaacatgc aagaagagtg caactaatac
3661 tgagagaatg gtcttctcgg tagtgcaagc accccgggta ctgcaaagct gtatggttgt
3721 ggcgaacaga tactcgtcag tgaatgcagt taagcacgtg aaagtaccag agaagatacc
3781 tgggagcgga accctagagt acaaggtgaa ctttgtctct ttgacggtgg tgccgaagaa
3841 ggatgtctac aggatcccaa ccgcagcatt gaaagtgtct ggctcgagcc tgtacaatct
3901 tgcgctcaat gtcactattg atgtggaggt ggacccgaag agcccgttag tcaaatccct
3961 ttccaagtcc gacagtggat actacgctaa tctcttcttg catatcggac ttatgtccac
4021 tgtagataag aaggggaaga agtgacatt tgacaagctg gagaagaaga taggagact
4081 cgatctatcc gtcgggctca gcgatgtgct cggaccttcc gtgcttgtga aggcgagagg
4141 tgtacggact aggctgctgg cacctttctt ctctagcagt gggacagcct gctatcctat
4201 agcaaatgcc tctcctcagg tagccaagat actctggagt caaactgcgc gcctgcggag
4261 tgtaaaagtc atcattcaag cgggcaccca acgcgctgtc gcagtgaccg ctgaccatga
4321 ggttacctct actaagatag agaagaggca taccattgct aaatacaatc ctttcaagaa
4381 atcggctgca tctctgagac tgcaatccgc ccgcttcccc gaatcgccat ga
```

FIG. 184

M protein from Newcastle Disease Virus (NDV) strain B1
GenBank Accession Number NC_002617

MDSSRTIGLYFDSAHSSSNLLAFPIVLQDTGDGKKQIAPQYRIQ

RLDLWTDSKEDSVFITTYGFIFQVGNEEATVGIIDDKPKRELLSAAMLCLGSVPNTGD

LIELARACLTMMVTCKKSATNTERMVFSVVQAPQVLQSCRVVANKYSSVNAVKHVKAP

EKIPGSGTLEYKVNFVSLTVVPKKDVYKIPAAVLKISGSSLYNLALNVTINVEVDPRS

PLVKSLSKSDSGYYANLFLHIGLMTTVDRKGKKVTFDKLEKKIRSLDLSVGLSDVLGP

SVLVKARGARTKLLAPFFSSSGTACYPIANASPQVAKILWSQTACLRSVKIIQAGTQ

RAVAVTADHEVTSTKLEKGHTLAKYNPFKK

FIG. 185

M protein from Newcastle Disease Virus (NDV) strain B1
GenBank Accession Number NC_002617

```
                                                           a tggactcatc
3301 taggacaatt gggctgtact ttgattctgc ccattcttct agcaacctgt tagcatttcc
3361 gatcgtccta caagacacag gagatgggaa gaagcaaatc gccccgcaat ataggatcca
3421 gcgccttgac ttgtggactg atagtaagga agactcagta ttcatcacca cctatggatt
3481 catctttcaa gttgggaatg aagaagccac tgtcggcatt atcgatgata aacccaagcg
3541 cgagttactt tccgctgcga tgctctgcct aggaagcgtc ccaaataccg gagaccttat
3601 tgagctggca agggcctgtc tcactatgat ggtcacatgc aagaagagtg caactaatac
3661 tgagagaatg gttttctcag tagtgcaggc accccaagtg ctgcaaagct gtagggttgt
3721 ggcaaacaaa tactcatcag tgaatgcagt caagcacgtg aaagcgccag agaagatccc
3781 cgggagtgga accctagaat acaaggtgaa ctttgtctcc ttgactgtgg taccgaagaa
3841 ggatgtctac aagatcccag ctgcagtatt gaagatttct ggctcgagtc tgtacaatct
3901 tgcgctcaat gtcactatta atgtggaggt agacccgagg agtcctttgg ttaaatctct
3961 gtctaagtct gacagcggat actatgctaa cctcttcttg catattggac ttatgaccac
4021 cgtagatagg aaggggaaga aagtgacatt tgacaagctg gaaaagaaaa taaggagcct
4081 tgatctatct gtcgggctca gtgatgtgct cgggccttcc gtgttggtaa aagcaagagg
4141 tgcacggact aagcttttgg cacctttctt ctctagcagt gggacagcct gctatcccat
4201 agcaaatgct tctcctcagg tggccaagat actctggagt caaaccgcgt gcctgcggag
4261 cgttaaaatc attatccaag caggtaccca acgcgctgtc gcagtgaccg ctgaccacga
4321 ggttacctct actaagctgg agaaggggca caccttgcc aaatacaatc cttttaagaa
4381 ataa
```

FIG. 186

M protein from Newcastle Disease Virus (NDV) strain Anhinga
GenBank Accession Number AY562986

MDSSRTIGLYFDSALPSSSLLAFPIVLQTTGDGKKQITPQYRIQ

RLDLWTDSKEDSVFITTYGFIFQVGDEEATVGTINDNPRQELLSSAMLCLGSVPNDGN

LIELARACLTMVITCKKSATNTERMVFSIVQAPQVLQSCMVVANKYSSVNAVKHVKAP

EKIPGSGTLEFKVNFVSLTVVPRKDVYRIPTAALKVSGSSLYNLALNVTIDVEVDPKS

PLVKSLSKSDGGYYANLFLHIGLMSTVDKKGKKVTFDKLEEKIRRLNLSVGLSDVLGP

SVLVKARGARTKLLAPFFSSSGTACYPIANASPQVAKILWSQTAHLRSVKAIIQAGTQ

RAVAVTSDHEVTSTKIEKGCAIAKYNPFKK"

FIG. 187

M protein from Newcastle Disease Virus (NDV) strain Anhinga
GenBank Accession Number AY562986

```
                                                                 atgga
3301 ctcatccagg acaatcggac tgtactttga ttctgccctt ccttccagca gcttgcttgc
3361 tttcccgatc gtcttacaga ctacaggaga tgggaagaag caaatcaccc cacaatatag
3421 gatccagcgt cttgacttgt ggacggacag caaagaagat tcggtattca tcaccaccta
3481 cggattcatt ttccaagtcg gggacgaaga agccactgtc ggcacgatca atgataaccc
3541 caggcaagag ttactttctt ctgcaatgct ctgcctaggg agtgttccta atgacggaaa
3601 tctcattgag ctggcaaggg cctgcctcac tatggtgata acgtgcaaga agagtgcaac
3661 caatactgag agaatggtct tctcaatagt gcaggcaccc caggtgctgc aaagctgtat
3721 ggttgtggca ataagtact catcagtaaa tgcagtaaaa catgtaaaag caccagagaa
3781 gatccccggg agcggaactc tagagtttaa ggtgaacttt gtctctttga ctgtagtgcc
3841 aaggaaggat gtctacagga tccctaccgc agcattgaaa gtatctggct cgagcctgta
3901 taatcttgcg ctcaatgtca ctattgatgt ggaagtggac ccaaagagcc cattagtcaa
3961 atccctttcc aagtccgatg gcggatatta tgccaatctc ttcttacata tcgggcttat
4021 gtccactgta gataaaaagg gaaagaaagt gacatttgac aagctggaag agaagataag
4081 aagactcaat ctatctgttg ggctcagtga tgtgctcgga ccttccgtgc tcgtgaaggc
4141 gagaggtgca cggaccaagc tgctggcacc tttttttctct agcagtggga cagcttgtta
4201 ccctatagca aatgcttctc cccaggttgc caagatactt ggagtcaaa ctgcgcacct
4261 gcgaagtgta aaggccatca ttcaagcggg cacccaacgt gctgtcgcag tgacctctga
4321 ccatgaggtt acctctacca agatagagaa ggggtgcgcc attgctaaat acaaccctt
4381 caagaaatag
```

FIG. 188

M protein from Newcastle Disease Virus (NDV) strain dove
GenBank Accession Number AY562989

MDSSRTIGLYFDSALSSSNLLAFPIVLQDTGDGKKQIAPQYRIQ

RLDSWTDSKEDSVFITTYGFIFQVGNEEATVGMIDDKPKRELLSAAMLCLGSVPNTGD

LVELARACLTMMVTCKKSATNTERMVFSVVQAPQVLQSCRVVANKYSSVNAVKHVKAP

EKIPGSGTLEYKVNFVSLTVVPKKDVYKIPTAALKISGSSLYNLALNVTIDVEVDPKS

PLVRSLSKSDSGYYANLFLHIGLMSTVDKKGKKVSFDKIEGKIRRLNLSVGLSDVLGP

SVLVKARGARTKLLAPFFSSSGTACYPIANASPQVAKILWSQTAHLRSVKVIIQAGTQ

RAVAVTADHEVTSTKIEKRHTIAKYNPFKK

FIG. 189

M protein from Newcastle Disease Virus (NDV) strain dove
GenBank Accession Number AY562989

```
                                                                   atgga
3301 ctcatctagg acaattgggc tgtactttga ttctgccctt tcttctagca acctgttagc
3361 atttccgatc gtcctacaag acacaggaga tgggaagaag caaatcgccc cgcaatatag
3421 gatccagcgc cttgactcgt ggactgatag taaggaagac tcagtattca tcaccaccta
3481 tggattcatc tttcaagttg ggaatgagga agccactgtc ggcatgatcg atgataaacc
3541 caagcgcgag ttactttccg ctgcgatgct ctgcctagga agcgtcccaa ataccggaga
3601 ccttgttgag ctggcaaggg cctgtctcac tatgatggtc acatgcaaga agagtgcaac
3661 taatactgag agaatggttt tctcagtagt gcaggcaccc caagtgctgc aaagctgtag
3721 ggttgtggca aacaaatact catcagtgaa tgcagtcaag cacgtgaaag cgccagagaa
3781 gatccccggg agtggaaccc tagaatacaa ggtgaacttt gtctccttga ctgtggtacc
3841 gaagaaggat gtctacaaga tcccaactgc agcattgaaa atctctggct cgagcctgta
3901 caacctcgca ctcaatgtca ctattgacgt ggaggtagac ccgaagagcc cgttggtcag
3961 atcccttcct aagtctgata gtggatacta tgctaatctt tttttgcata tcgggcttat
4021 gtccactgta gataagaagg gaaagaaagt gtcatttgac aagatagagg gaaagataag
4081 gagactcaat ctttctgtcg ggctcagtga tgtgctcgga ccttctgtgc ttgtgaaggc
4141 gagaggtgca cggactaagc tactggcacc ttttttctct agcagcggga cagcctgcta
4201 tcctatagca aatgcctctc tcaggttgc taagatactc tggagtcaaa ctgcgcacct
4261 gcgaagtgta aaagtcatca ttcaagctgg cacccaacgt gccgtcgcag tgactgctga
4321 tcatgaggtt acctctacta agatagaaaa gaggcacacc attgctaagt acaacccttt
4381 taaaaagtaa
```

FIG. 190

M protein from Newcastle Disease Virus (NDV) strain Fontana/72
GenBank Accession Number AY562988

MDSSRTIGLYFDSALPSSSLLAFPIVLQDTGDGKKQITPQYRIQ

RLDSWTDSKEDSVFITTYGFIFQIGNEEVTVGMINDNPRHELLSSAMLCLGSVPNDGD

LVELARACLTMVVTCKKSATNTERIVFSVVQAPRVLQSCMVVANRYSSVNAVKHVKAP

EKIPGSGTLEYKVNFVSLTVVPRKDVYRIPTAALKISGSSLYNLALNVTIDVEVDPKS

PLVKSLSKSDSGYYANLFLHIGLMSTVDKKGKKVTFDKIEGKIRRLNLSVGLSDVLGP

SVLVKPRGARTKLLAPFFSSSGTACYPIANASPQVAKILWSQTAHLRSVKVIIQAGTQ

RAVAVTADHEVTSTKIEKKHTIAKYNPFKK

FIG. 191

M protein from Newcastle Disease Virus (NDV) strain Fontana/72
GenBank Accession Number AY562988

```
                                                                      atgga
3301 ctcatccagg acaatcgggc tgtactttga ttctgccctc ccttccagca gcctgttagc
3361 attcccgatc gtcctacaag acacaggaga tgggaagaag caaatcaccc cacaatacag
3421 gatccagcgt cttgactcgt ggacagacag taaggaagac tcggtattta tcaccaccta
3481 cggattcatc ttccaaattg ggaatgaaga agtcaccgtc ggcatgatca acgacaatcc
3541 caggcacgag ttactttctt ctgcgatgct ctgcctagga agtgtcccga acgatggaga
3601 tcttgttgaa ctggcgaggg cctgcctcac tatggtggta acttgcaaga agagtgcgac
3661 taatactgaa agaatagtct tctcagtagt gcaggcacct cgggtgctgc aaagctgtat
3721 ggttgtggca aataggtact catcagtgaa tgcagtgaag catgtgaaag cacccgagaa
3781 gatccctggg agcggaaccc tagagtataa ggtgaatttt gtctctttga ctgtggtgcc
3841 gaggaaagac gtctatagga tcccaactgc agcattgaaa atatctggct caagcctata
3901 caatctcgcg ctcaatgtca ctattgatgt ggaggtagac ccgaagagcc cgttagtcaa
3961 atcccttttct aagtctgata gtggatacta tgctaatctt tttttgcata tcgggcttat
4021 gtccactgta gataagaagg gaaagaaagt gacatttgac aagatagagg gaaagataag
4081 aagactcaat ctatctgtcg ggctcagtga tgtgctcgga ccttctgtgc ttgtgaagcc
4141 gagaggtgca cggactaagc .tactggcacc tttcttctct agcagtggga cagcctgcta
4201 tcctatagca aatgcctctc cccaggttgc taaaatactc tggagccaaa ctgcgcacct
4261 gcggagtgta aaagtcatca ttcaagctgg cacccaacgt gctgtcgcag tgactgctga
4321 tcatgaggtt acctctacca agatagagaa gaaacacacc attgctaaat acaatccttt
4381 caaaaagtaa
```

FIG. 192

M protein from Newcastle Disease Virus (NDV) strain Largo
GenBank Accession Number AY562990

MDSSRTIGLYFDSALPSSSLLAFPIVLQTTGDGKKQITPQYRIQ

RLDSWTDSKEDSVFITTYGFIFQVGNEEVTVGTINDNPRQELLSSAMLCLGSVPNGD

LVELARACLTMVVTCKKSATNTERIVFSIVQAPRVLQSCMVVANRYSSVNAVKHVKAP

EKIPGSGTLEYKVNFVSLTVVPRKDVYRIPTAALKVSGSSLYNLALNVTIDVEVDPKS

PLVKSLSKSDSGYYANLFLHIGLMSTVDKKGKKVTFDKLERKIRRLNLSVGLSDVLGP

SVLVKARGARTKLLAPFFSSSGTACYPIANASPQVAKILWSQTAHLRSVKVIIQAGTQ

RAVAVTADHEVTSTKIEKRHTIAKYNPFEK

FIG. 193

M protein from Newcastle Disease Virus (NDV) strain Largo
GenBank Accession Number AY562990

```
                      acgggtaga atcaaagtgc cctgactgtg ctaaaatgga
3301 ctcatccagg acaatcggac tgtactttga ttctgccctt ccttccagca gcctgcttgc
3361 tttcccgatc gtcctacaaa ccacaggaga tgggaagaag caaatcaccc cacaatatag
3421 gatccagcgt cttgactcgt ggacggacag caaagaagat tcggtattta tcaccaccta
3481 cgggttcatc ttccaagtcg ggaatgaaga agtcactgtc ggcacgatca atgataaccc
3541 taggcaagag ttactttctt ctgcaatgct ctgcctaggg agtgtcccta atgacggaga
3601 tctcgttgag ctggcgaggg cctgcctcac tatggtggta acgtgcaaga agagtgcaac
3661 caatactgag agaatagtct tctcgatagt gcaggcaccc cgggtgctgc aaagctgtat
3721 ggttgtggca ataggtact catcagtgaa tgcagtaaag catgtaaaag caccagagaa
3781 gatccccggg agcggaactc tagagtataa ggtgaacttt gtctctttga ctgtggtgcc
3841 gaggaaggat gtctacagga tcccaaccgc agcattgaaa gtatctggct cgagcctgta
3901 caatcttgcg ctcaatgtca ctattgatgt ggaggtggac ccgaagagcc cattagtcaa
3961 atcccttttcc aagtccgata gtggatacta tgctaatctt tcttacata tcgggcttat
4021 gtccactgta gataaaaagg gaaagaaagt gacatttgac aagctggaaa ggaagataag
4081 aagactcaat ctatctgttg ggctcagtga tgtgctcgga ccttctgtgc ttgtgaaggc
4141 gagaggtgca cggactaagc tgttggcacc tttcttctct agcagtggga cagcctgcta
4201 ccctatagca aatgcttctc cccaggttgc taagatactc tggagtcaaa ctgcgcacct
4261 gcgaagtgta aaggtcatca ttcaagcggg cacccaacgt gctgtcgcag tgaccgctga
4321 ccatgaggtt acctctacta agatagagaa gaggcatact attgctaaat acaaccccttt
4381 cgagaaatag gttgtattcc tgatactatt gtctgcccgc tttcctgaat cattgcgaca
4441 ctagataatg atctgctttg attgcttata gttagtttac ctgtctatcc aattagaaaa
4501 aa
```

FIG. 194

M protein from Newcastle Disease Virus (NDV) Strain LaSota
GenBank Accession Number AY845400

MDSSRTIGLYFDSAHSSSNLLAFPIVLQGTGDGKKQIAPQYRIQ

RLDLWTDSKEDSVFITTYGFIFQVGNEEATVGMIDDKPKRELLSAAMLCLGSVPNTGD

LIELARACLTMIVTCKKSATNTERMVFSVVQAPQVLQSCRVVANKYSSVNAVKHVKAP

EKIPGSGTLEYKVNFVSLTVVPKKDVYKIPAAVLKVSGSSLYNLALNVTINVEVDPRS

PLVKSLSKSDSGYYANLFLHIGLMTTVDRKGKKVTFDKLEKKIRSLDLSVGLSDVLGP

SVLVKARGARTKLLAPFFSSSGTACYPIANASPQVAKILWSQTACLRSVKIIQAGTQ

RAVAVTADHEVTSTKLEKGHTLAKYNPFKK

FIG. 195

M protein from Newcastle Disease Virus (NDV) Strain LaSota
GenBank Accession Number AY845400

```
                                                                a tggactcatc
3301 taggacaatt gggctgtact ttgattctgc ccattcttct agcaacctgt tagcatttcc
3361 gatcgtccta caaggcacag gagatgggaa gaagcaaatc gccccgcaat ataggatcca
3421 gcgccttgac ttgtggactg atagtaagga ggactcagta ttcatcacca cctatggatt
3481 catctttcaa gttgggaatg aagaagccac tgtcggcatg atcgatgata aacccaagcg
3541 cgagttactt tccgctgcga tgctctgcct aggaagcgtc ccaaataccg gagacctat
3601 tgagctggca agggcctgtc tcactatgat agtcacatgc aagaagagtg caactaatac
3661 tgagagaatg gttttctcag tagtgcaggc accccaagtg ctgcaaagct gtagggttgt
3721 ggcaaacaaa tactcatcag tgaatgcagt caagcacgtg aaagcgccag agaagattcc
3781 cgggagtgga accctagaat ataaggtgaa ctttgtctcc ttgactgtgg taccgaagaa
3841 ggatgtctac aagatcccag ctgcagtatt gaaggtttct ggctcgagtc tgtacaatct
3901 tgcgctcaat gtcactatta atgtggaggt tgacccgagg agtcctttgg ttaaatctct
3961 gtctaagtct gacagcggat actatgctaa cctcttcttg catattggac ttatgaccac
4021 cgtagatagg aagggaaga aagtgacatt tgacaagctg gaaaagaaaa taaggagcct
4081 tgatctatct gtcgggctca gtgatgtgct cgggccttcc gtgttggtaa aagcaagagg
4141 tgcacggact aagcttttgg cacctttctt ctctagcagt gggacagcct gctatcccat
4201 agcaaatgct tctcctcagg tggccaagat actctggagt caaaccgcgt gcctgcggag
4261 cgttaaaatc attatccaag caggtaccca acgcgctgtc gcagtgaccg ccgaccacga
4321 ggttacctct actaagctgg agaaggggca caccctttgcc aaatacaatc cttttaagaa
4381 ataa
```

FIG. 196

M protein from Newcastle Disease Virus (NDV) Pigeon
GenBank Accession Number AJ880277

MDSSRTIGLYFDSALPSSSLLAFPIVLQDTGDGKKRITPQYRIQ

RLDSWTDSKEDSVFITTYGFIFQIGNEEVTVGMINDNPRHELLSSAMLCLGSVPNDGD

LVELARACLTMAVTCKKSATNTERIVFSVVQAPRVLQSCMVVANRYSSVNAVKHVKAP

EKIPGSGTLEYKVNFVSLTVVPRKDVYRIPTAALKISGSSLYNLALNVTIDVEVDPKS

PLVKSLSKSDSGYYANLFLHIGLMSTVDRKGKKVTFDKIEGKIRRLNLSVGLSDVLGP

SVLVKARGARTKLLAPFFSSSGTACYPIANASPQVAKILWSQTAHLRSVKVIIQAGTQ

RAVAVTADHEVTSTKIEKKHTIAKYNPFKK

FIG. 197

M protein from Newcastle Disease Virus (NDV) Pigeon
GenBank Accession Number AJ880277

```
                          acgggtaga atcaaaatac cccgattgtg ccaaaatgga
3301 ctcatccaga acaatcgggt tgtactttga ttctgccctc ccttccagca gcctgttagc
3361 attcccgatc gtcttacaag acacaggaga tgggaagaaa cgaatcaccc cacaatacag
3421 gatccagcgt cttgactcgt ggacagacag taaggaagac tcagtattta tcaccaccta
3481 cggattcatc ttccaaattg ggaatgaaga ggtcactgtt ggcatgatca acgacaatcc
3541 cagacacgag ttactttcct ctgcaatgct ctgcctagga agtgtcccga atgacggaga
3601 tcttgttgaa ctggcaaggg cctgcctcac tatggcggta acatgcaaga agagtgcaac
3661 taatactgag agaatagtct tctcagtagt gcaggcacct cgggtgctgc aaagctgtat
3721 ggttgtggca aataggtact catcagtgaa tgcagtgaag catgtgaaag cacccgagaa
3781 gatccctggg agcggaaccc tagagtataa agtgaatttt gtctctttga ctgtggtgcc
3841 gaggaaggat gtctacagga tcccaactgc agcattgaaa atctctggct caagcctata
3901 caacctcgcg ctcaatgtca ctattgacgt ggaggtagac ccgaagagcc cgctagtcaa
3961 atccctttct aagtctgata gtggatacta tgctaatctt tttttgcata tcgggcttat
4021 gtctactgta gataggaagg gaaagaaagt gacatttgac aagatagaag gaaagataag
4081 aagactcaat ctatctgtcg ggctcagtga tgtgctcgga ccttctgtgc ttgtgaaggc
4141 gagaggtgca cgaactaagc tactggcacc tttttttctct agcagcggga cagcctgcta
4201 tcctatagca aatgcctctc ctcaggttgc taagatactc tggagtcaaa ctgcgcacct
4261 gcggagtgta aaggtcatca ttcaagctgg cacccaacgt gctgtcgcag tgactgctga
4321 tcatgaggtt acctctacta agatagagaa gaagcacacc attgctaagt acaatccttt
4381 caagaagtag gttgcatctc tgagactgcg agccacccac tttcctaaat catcgcgaca
4441 ctagataatg atctatcttg attgcttata attagttcac ctgtctatct aattagaaaa
4501 aa
```

FIG. 198

M protein from Newcastle Disease Virus (NDV), strain Italien
GenBank Accession Number EU293914

MDSSRTIGLYFDSTLPSSNLLAFPIVLQDTRDGKKQITPQYRIQ

RLDSWTDSKEDSVFITTYGFIFQVGSEEVTVGMINDNPKHELLSSAMLCLGSVPNDGD

LVELARACLTMVVTCKKSATNTERMVFSVVQAPRVLQSCTVVANRYSSVNAVKHVKVP

EKIPGSGTLEYKVNFVSLTVVPRKDVYRIPTAALKVSGSSLYNLALNVTIDVEVDPKS

PLVKSLSKSDSGYYANLFLHIGLMSTVDKKGKKVTFDKLERKIRRLDLSVGLSDVLGP

SVLVKARGARTRLLAPFFSSSGTACYPIANASPQVAKILWSQTARLRSVKVIIQAGTQ

RAVAVTADHEVTSTKIEKRHTIAKYNPFKK

FIG. 199

M protein from Newcastle Disease Virus (NDV), strain Italien
GenBank Accession Number EU293914

```
                                                                 a tggactcatc
3301 caggacaatc gggctgtact tcgattccac ccttccttcc agcaacctgt tagcattccc
3361 gatcgtccta caagacacaa gagatgggaa gaagcaaatc accccgcaat ataggatcca
3421 gcgtcttgac tcgtggacag acagtaaaga agattcggta tttatcacca cctatggatt
3481 catcttccag gttgggagtg aggaagtcac tgtcggcatg atcaatgata atcccaagca
3541 cgagttactt tcctctgcga tgctctgcct aggaagtgtc ccgaatgatg gagatcttgt
3601 tgagctggcg agggcctgcc ttactatggt ggtaacatgc aagaagagtg cgactaatac
3661 tgagagaatg gtcttctcgg tagtgcaagc acccgggta ctgcaaagct gtacggttgt
3721 ggcgaacaga tactcgtcag tgaatgcagt taagcacgtg aaagtaccag agaagatccc
3781 tgggagcgga accctagagt acaaggtgaa ctttgtctct ctgactgtgg tgccgaggaa
3841 ggatgtctac aggatcccaa ccgcggcatt gaaagtgtct ggctcgagcc tgtacaatct
3901 tgcgctcaat gtcactattg atgtggaggt ggacccgaag agcccgttag tcaaatccct
3961 ttccaagtcc gacagtggat actacgctaa tctcttcttg catatcggac ttatgtccac
4021 tgtagataag aaggggaaga aagtgacatt tgacaagctg gagaggaaga taaggagact
4081 cgatctatcc gtcgggctca gtgatgtgct cggaccttcc gtgcttgtga aggcgagagg
4141 tgcacggact aggctgctgg caccttttt ctctagcagt gggacagcct gctatcctat
4201 agcaaatgcc tctcctcagg tagctaagat actctggagt caaactgcgc gcctgcggag
4261 tgtaaaagtc atcatccaag cgggcaccca acgcgctgtc gcagtgactg ctgaccatga
4321 ggttacctct actaagatag agaagaggca taccattgct aaatacaatc ctttcaagaa
4381 atag
```

FIG. 200

M protein from Newcastle Disease Virus (NDV) strain ZJ1
GenBank Accession Number AF431744

MDSSRTIGLYFDSALPSSSLLAFPIVLQDTGDGKKQITPQYRIQ

RLDSWTDSKEDSVFITTYGFIFQIGNEEATVGVINDNPKHELLSSAMLCLGSVPNDGD

LVELARACLTMVVTCKKSATNTERIVFSVVQAPRVLQSCMVVANRYSSVNAVKHVKAP

EKIPGSGTLEYKVNFVSLTVVPRRDVYRIPTAVLKVSGSSLYNLALNVTIDVDVDPKS

PLVKSLSKSDSGYYANLFLHIGLMSTVDKKGKKVIFDKIEEKIRRLNLSVGLSDVLGP

SVLVKARGARTKLLAPFFSSSGTACYPIANASPQVAKILWSQTAHLRSVKVIIQAGTQ

RAVAVTADHEVTSTKIERRHAIAKYNPFRK

FIG. 201

M protein from Newcastle Disease Virus (NDV) strain ZJ1
GenBank Accession Number AF431744

```
                                                                    atgga
3301 ctcatccagg acaatcgggc tgtactttga ttctgccctc ccttccagca gcctgttagc
3361 atttccgatt gtcttacaag acacaggaga cgggaagaag caaatcaccc cacaatacag
3421 gatccagcgc cttgattcgt ggacagacag taaggaagac tcggtattca tcaccaccta
3481 cgggttcatc tttcaaattg ggaatgaaga agccactgtc ggtgtgatca atgacaatcc
3541 caagcacgag ctactctctt ccgcaatgct ctgcttaggg agtgtcccga acgacggaga
3601 tcttgttgag ctggcaagag cctgcctcac catggtggta acttgcaaga agagtgcaac
3661 taacactgag agaatagtct tctcagtagt gcaggcacct cgggtgctgc aaagctgtat
3721 ggttgtggca ataggtact catcagtgaa tgcagtgaag catgtgaagg cgccagaaaa
3781 gatccctggg agcggaaccc tagagtataa agtgaatttt gtctctttga ccgtggtgcc
3841 aagaagggat gtctacagga tcccaactgc agtattgaaa gtgtctggct caagcctgta
3901 caatcttgcg ctcaatgtca ctattgatgt ggacgtggat ccgaagagcc cgttagtcaa
3961 atccctttct aagtccgata gcggatacta tgcgaatctt tttctgcata tcgggcttat
4021 gtccactgta gataagaagg gaaagaaagt gatatttgac aagatagagg aaaagataag
4081 gagactcaat ctatccgtcg ggctcagtga tgtgctcgga ccctctgtgc ttgtgaaggc
4141 gagaggtgca cggactaagt tacttgctcc tttcttctct agcagtggga cagcctgcta
4201 tcctatagca aatgcctctc cccaggttgc caagatactc tggagccaaa ctgcgcactt
4261 gcggagtgtg aaagtcatca ttcaagccgg cactcagcgt gctgtcgcag tgaccgctga
4321 tcatgaggta acctccacta agatagagag gaggcatgcc attgctaaat acaatccttt
4381 caggaaataa
```

FIG. 202

M protein from Newcastle Disease Virus (NDV), strain Ulster
GenBank Accession Number AY562991

MDSSRTIGLYFDSALPSSNLLAFPIVLQDTGDGKKQIAPQYRIQ

RLDSWTDSKEDSVFITTYGFIFQVGNEEATVGMINDNPKRELLSAAMLCLGSVPNVGD

LVELARACLTMVVTCKKSATNNERMVFSVVQDPQVLQSCRVVANKYSPVNAVKYVKPP

EKIPGIGTLEYQVNFVSLPVVPMQDVYKIPTAALKVSGSSLHNLALNVTIDVEVDPKS

PLVKSLSKSDSGYYANLFLHIGLMSTVDKKGKKVTFDKLERKIRRLDLSVGLSDVLGP

SVLVKARGARTKLLAPFFSSSGTACYPIANASPQVAKILWSQTACLRSVKVIIQAGTQ

RAVAVTADHEVTSTKLEKGHTIAKYNPFKK

FIG. 203

M protein from Newcastle Disease Virus (NDV), strain Ulster
GenBank Accession Number AY562991

```
                                                             a tggactcatc
3301 taggacaatc gggctgtact ttgattctgc ccttccttct agcaacctgt tagcattccc
3361 gatcgtccta caagacacag gggacgggaa gaagcaaatc gccccgcaat ataggatcca
3421 gcgtcttgac tcgtggacag acagcaaaga ggactcggtg ttcatcacta cctatggatt
3481 catctttcag gttgggaatg aagaagccac tgtcggcatg atcaatgata atcccaagcg
3541 cgagttactt tccgctgcaa tgctctgcct aggaagtgtc ccaaatgtcg gagatcttgt
3601 cgagctggca agggcctgcc tcactatggt agtaacatgc aagaagagtg caactaacaa
3661 cgagagaatg gtcttctcag tagtgcagga cccccaggtg ctgcaaagct gcagggttgt
3721 ggcaaacaaa tactcgccgg tgaatgcagt caagtacgtg aaaccgccag agaagatccc
3781 tgggatcgga accctagagt accaggtgaa ctttgtctcc ttgcccgtgg taccgatgca
3841 ggatgtctac aagataccaa ctgcagcact aaaggtctct ggctcgagtc tgcacaatct
3901 tgcgctcaat gtcactattg atgtggaggt agacccgaag agcccgttgg tcaaatctct
3961 ttccaagtcc gacagtggat actatgctaa tctcttctta catattgggc ttatgtccac
4021 tgtagataag aaggggaaga aagtgacatt tgacaagctg gagaggaaga taaggagact
4081 tgatctatct gtcgggctca gtgacgtgct cggaccttcc gtacttgtga aggcgagagg
4141 tgcaaggact aagctgctgg cacctttctt ctctagcagt gggacagcct gctatcccat
4201 agcaaatgcc tctcctcagg tggctaagat actctggagt caaactgcgt gcctgcggag
4261 tgtcaaagtc attatccaag caggtaccca gcgcgctgtc gcagtgaccg ctgaccatga
4321 ggttacctct actaagctgg agaaggggca taccattgcc aaatacaatc ctttcaagaa
4381 atag
```

FIG. 204

Presenilin (human) protein (Type 3 Protein)

```
mtelpaplsy fqnaqmsedn hlsntvrsqn dnrerqehnd rrslghpepl sngrpqgnsr
qvveqdeeed eeltlkygak hvimlfvpvt lcmvvvvati ksvsfytrkd gqliytpfte
dtetvgqral hsilnaaimi svivvmtill vvlykyrcyk vihawliiss llllfffsfi
ylgevfktyn vavdyitval liwnfgvvgm isihwkgplr lqqaylimis almalvfiky
lpewtawlil avisvydlva vlcpkgplrm lvetaqerne tlfpaliyss tmvwlvnmae
gdpeaqrrvs knskynaest eresqdtvae nddggfseew eaqrdshlgp hrstpesraa
vqelsssila gedpeergvk lglgdfifys vlvgkasata sgdwnttiac fvailiglcl
tllllaifkk alpalpisit fglvfyfatd ylvqpfmdql afhqfyi
```

FIG. 205

Influeza Virus Fujian strain HA protein ectodomain (Type 1 protein)

MKTIIALSYILCLVFAQKLPGNDNSTATLCLGHHAVPNGTIVKTITNDQIEVTNATELVQS
SSTGGICDSPHQILDGENCTLIDALLGDPQCDGFQNKKWDLFVERSKAYSNCYPYDVPD
YASLRSLVASSGTLEFNNESFNWTGVTQNGTSSACKRRSNKSFFSRLNWLTHLKYKYPA
LNVTMPNNEKFDKLYIWGVLHPGTDSDQISLYAQASGRITVSTKRSQQTVIPNIGSRPRV
RDVSSRISIYWTIVKPGDILLINSTGNLIAPRGYFKIRSGKSSIMRSDAPIGKCNSECITPNG
SIPNDKPFQNVNRITYGACPRYIKQNTLKLATGMRNVPEKQTRGIFGAIAGFIENGWEGM
VDGWYGFRHQNSEGTGQAADLKSTQAAINQINGKLNRLIGKTNEKFHQIEKEFSEVEGR
IQDLEKYVEDTKIDLWSYNAELLVALENQHTIDLTDSEMNKLFERTKKQLRENAEDMG
NGCFKIYHKCDNACIGSIRNGTYDHDVYRDEALNNRFQIKGVELKSGYKD

FIG. 206

CMV gB protein ectodomain (Type 1 protein)

MESRIWCLVVCVNLCIVCLGAAVSSSSTRGTSATHSHHSSHTTS

AAHSRSGSVSQRVTSSQTVSHGVNETIYNTTLKYGDVVGVNTTKYPYRVCSMAQGTDL

IRFERNIVCTSMKPINEDLDEGIMVVYKRNIVAHTFKVRVYQKVLTFRRSYAYIHTTY

LLGSNTEYVAPPMWEIHHINSHSQCYSSYSRVIAGTVFVAYHRDSYENKTMQLMPDDY

SNTHSTRYVTVKDQWHSRGSTWLYRETCNLCMVTITTARSKYPYHFFATSTGDVVDI

SPFYNGTNRNASYFGENADKFFIFPNYTIVSDFGRPNSALETHRLVAFLERADSVISW

DIQDEKNVTCQLTFWEASERTIRSEAEDSYHFSSAKMTATFLSKKQEVNMSDSALDCV

RDEAINKLQQIFNTSYNQTYEKYGNVSVFETTGGLVVFWQGIKQKSLVELERLANRSS

LNLTHNRTKRSTDGNNATHLSNMESVHNLVYAQLQFTYDTLRGYINRALAQIAEAWCV

DQRRTLEVFKELSKINPSAILSAIYNKPIAARFMGDVLGLASCVTINQTSVKVLRDMN

VKESPGRCYSRPVVIFNFANSSYVQYGQLGEDNEILLGNHRTEECQLPSLKIFIAGNS

AYEYVDYLFKRMIDLSSISTVDSMIALDIDPLENTDFRVLELYSQKELRSSNVFDLEE

IMREFNSYKQRVKYVEDKVVDPLPPYLKGLDDLMSGLGAAGKAVGVAIGAVGGAVASV

VEGVATFLKNP

FIG. 207

CMV gH protein ectodomain (Type 1 protein)

MRPGLPSYLIILAVCLFSHLLSSRYGAEAVSEPLDKAFHLLLNTYGRPIRFLRENTTQCTY
NSSLRNSTVVRENAISFNFFQSYNQYYVFHMPRCLFAGPLAEQFLNQVDLTETLERYQQ
RLNTYALVSKDLASYRSFSQQLKAQDSLGEQPTTVPPPIDLSIPHVWMPPQTTPHGWTES
HTTSGLHRPHFNQTCILFDGHDLLFSTVTPCLHQGFYLIDELRYVKITLTEDFFVVTVSID
DDTPMLLIFGHLPRVLFKAPYQRDNFILRQTEKHELLVLVKKDQLNRHSYLKDPDFLDA
ALDFNYLDLSALLRNSFHRYAVDVLKSGRCQMLDRRTVEMAFAYALALFAAARQEEA
GAQVSVPRALDRQAALLQIQEFMITCLSQTPPRTTLLLYPTAVDLAKRALWTPNQITDIT
SLVRLVYILSKQNQQHLIPQWALRQIADFALKLHKTHLASFLSAFARQELYLMGSLVHS
MLVHTTERREIFIVETGLCSLAELSHFTQLLAHPHHEYLSDLYTPCSSSGRRDHSLERLTR
LFPDATVPATVPAALSILSTMQPSTLETFPDLFCLPLGESFSALTVSEHVSYIVTNQYLIKG
ISYPVSTTVVGQSLIITQTDSQTKCELTRNMHTTHSITVALNISLENCAFCQSALLEYDDT
QGVINIMYMHDSDDVLFALDPYNEVVVSSPRTHYLMLLKNGTVLEVTDVVVDATDSR

FIG. 208

Ebola G protein ectodomain (Type 1 protein)

MGVTGILQLPRDRFKRTSFFLWVIILFQRTFSIPLGVIHNSTLQ

VSDVDKLVCRDKLSSTNQLRSVGLNLEGNGVATDVPSATKRWGFRSGVPPKVVNYEAG

EWAENCYNLEIKKPDGSECLPAAPDGIRGFPRCRYVHKVSGTGPCAGDFAFHKEGAFF

LYDRLASTVIYRGTTFAEGVVAFLILPQAKKDFFSSHPLREPVNATEDPSSGYYSTTI

RYQATGFGTNETEYLFEVDNLTYVQLESRFTPQFLLQLNETIYTSGKRSNTTGKLIWK

VNPEIDTTIGEWAFWETKKNLTRKIRSEELSFTVVSNGAKNISGQSPARTSSDPGTNT

TTEDHKIMASENSSAMVQVHSQGREAAVSHLTTLATISTSPQSLTTKPGPDNSTHNTP

VYKLDISEATQVEQHHRRTDNDSTASDTPSATTAAGPPKAENTNTSKSTDFLDPATTT

SPQNHSETAGNNNTHHQDTGEESASSGKLGLITNTIAGVAGLITGGRRTRREAIVNAQ

PKCNPNLHYWTTQDEGAAIGLAWIPYFGPAAEGIYIEGLMHNQDGLICGLRQLANETT

QALQLFLRATTELRTFSILNRKAIDFLLQRWGGTCHILGPDCCIEPHDWTKNITDKID

QIIHDFVDKTLPDQGDNDNWWTGWRQWIP

FIG. 209

Influenza virus HA H1 protein ectodomain (Type 1 protein)

MKVKLLVLLCTFTATYADTICIGYHANNSTDTVDTVLEKNVTVT

HSVNLLEDSHNGKLCLLKGIAPLQLGNCSVAGWILGNPECELLISKESWSYIVETPNP

ENGTCYPGYFADYEELREQLSSVSSFERFEIFPKESSWPNHXVTGVSASCSHNGKSSF

YRNLLWLTGKNGLYPNLSKSYANNKEKEVLVLWGVHHPPNIXDQRALYHTENAYVSVV

SSHYSRRFTPEIAKRPKVRDQEGRINYYWTLLEPGDTIIFEANGNLIAPRFAFALSRG

FGSGIITSNAPMDECDAKCQTPQGAINSSLPFQNVHPVTIGECPKYVRSTKLRMVTGL

RNIPSIQSRGLFGAIAGFIEGGWTGMVDGWYGYHHQNEQGSGYAADQKSTQNAINGIT

NKVNSVIEKMNTQFTAVGKEFNKLERRMENLNKKVDDGFLDIWTYNAELLVLLENERT

LDFHDSNVKNLYEKVKSQLKNNAKEIGNGCFEFYHKCNDECMESVKNGTYDYPKYSEE

SKLNREKIDGVKLESMGVYQ

FIG. 210

Influenza virus B HA protein ectodomain (Type 1 protein)

MKAIIVLLMVVTSNADRICTGITSSNSPHVVKTATQGEVNVTGVIPLTTTPTKSHFANLK
GTETRGKLCPKCLNCTDLDVALGRPKCTGNIPSARVSILHEVRPVTSGCFPIMHDRTKIR
QLPNLLRGYEHIRLSTHNVINAENAPGGSYKIGTSGSCPNVTNGNGFFATMAWAVPKND
NNKTATNSLTIEVPYICTEGEDQITVWGFHSDNEAQMAKLYGDSKPQKFTSSANGVTTH
YVSQIGGFPNQTEDGGLPQSGRIVVDYMVQKSGKTGTITYQRGILLPQKVWCASGRSKV
IKGSLPLIGEADCLHEKYGGLNKSKPYYTGEHAKAIGNCPIWVKTPLKLANGTKYRPPA
KLLKERGFFGAIAGFLEGGWEGMIAGWHGYTSHGAHGVAVAADLKSTQEAINKITKNL
NSLSELEVKNLQRLSGAMDELHNEILELDEKVDDLRADTISSQIELAVLLSNEGIINSEDE
HLLALERKLKKMLGPSAVEIGNGCFETKHKCNQTCLDRIAAGTFDAGEFSLPTFDSLNIT
AASLNDDGLDNHT

FIG. 211

Influenza virus H3 HA protein ectodomain (Type 1 protein)

MKTIIALSYILCLVFAQKLPGNDNSTATLCLGHHAVPNGTIVKT

ITNDQIEVTNATELVQSSSTGGICDSPHQILDGENCTLIDALLGDPQCDGFQNKKWDL

FVERSKAYSNCYPYDVPDYASLRSLVASSGTLEFNNESFNWTGVTQNGTSSACKRGSN

KSFFSRLNWLTHLKFKYPALNVTMPNNEKFDKLYIWGVHHPGTDNDQISLYAQASGRI

TVSTKRSQQTVIPNIGSRPRVRDIPSRISIYWTIVKPGDILLINSTGNLIAPRGYFKI

RSGKSSIMRSDAPIGKCNSECITPNGSIPNDKPFQNVNRITYGACPRYVKQNTLKLAT

GMRNVPEKQTRGIFGAIAGFIENGWEGMVDGWYGFRHQNSEGTGQAADLKSTQAAINQ

INGKLNRLIGKTNEKFHQIEKEFSEVEGRIQDLEKYVEDTKIDLWSYNAELLVALENQ

HTIDLTDSEMNKLFERTKKQLRENAEDMGNGCFKIYHKCDNACIGSIRNGTYDHDVYR

DEALNNRFQIKGVELKSGYKD

FIG. 212

HIV envelope protein ectodomain (Type 1 protein)

MRVKEIRRNYQHLWRWGTMLLGILMICSAAEKLWVTVYYGVPVW

KEANTTLFCASDAKATKAEVHNVWATHACVPTDPNPQELALENVTEKFDMWKNNMVEQ

MHEDIISLWDQSLKPCVKLTPLCVTLTCTDYSGNNNTNITGKANTTIDDIEMKNCSFN

ITTGIRDKVKREYALFYKVDVVPIEKNTSYRLIHCNTSTITQACPKVSFEPIPIHYCA

PAGFAILKCKDKKFNGTGLCTNVSTVQCTHGIRPVVSTQLLLNGSLAEEEVVIRSQNF

TDNVKTIIVQLNESVVINCTRPNNNTRKSIHIGPGGAFYTTGQVIGNIRQAYCNISEE

QWNKTLKYIVEKLREQFGNKTIIFNQSSGGDPEIVTHSFNCGGEFFYCNTSRLFNSTW

NITEGSNSTAGSNKNITLPCRIKQIINMWQEVGKAMYAPPISGLIRCTSNITGLLLTR

DGGHDNKTNDTEIFRPGGGNMRDNWRSELYKYKVVKIEPLGIAPTKARRRVVQRDKRA

VGIGAMFLGILGAAGSTMGAASITLTVQARQLLSGIVQQQNNLLRAIEAQQHLLQLTV

WGIKQLQARVLAVERYLKDQQLLGIWGCSGKLICTTNVPWNTSWSNRSLDYIWGNMTW

IQWEREIDNYTDLIYTLIEESQDQQEKNELELMKLDKWDSLWSWFSITNWLWYIR

FIG. 213

HSV gH protein ectodomain (Type 1 protein)

MGNGLWFVGVIILGAAWGQVHDWTEQTDPWFLDGLGMDRMYWRD

TNTGRLWLPNTPDPQKPPRGFLAPPDELNLTTASLPLLRWYEERFCFVLVTTAEFPRD

PGQLLYIPKTYLLGRPPNASLPAPTTVEPTAQPPPAVAPLKGLLHNPTASVLLRSRAW

VTFSAVPDPEALTFPRGDNVATASHPSGPRDTPPPRPPVGARRHPTTELDITHLHNAS

TTWLATRGLLRSPGRYVYFSPSASTWPVGIWTTGELVLGCDAALVRARYGREFMGLVI

SMHDSPPAEVMVVPAGQTLDRVGDPADENPPGALPGPPGGPRYRVFVLGSLTRADNGS

ALDALRRVGGYPEEGTNYAQFLSRAYAEFFSGDAGAEQGPRPPLFWRLTGLLATSGFA

FVNAAHANGAVCLSDLLGFLAHSRALAGLAARGAAGCAADSVFFNVSVLDPTARLQLE

ARLQHLVAEILEREQSLALHALGYQLAFVLDSPSAYDAVAPSAAHLIDALYAEFLGGR

VVTTPVVHRALFYASAVLRQPFLAGVPSAVQRERARRSLLIASALCTSDVAAATNADL

RTALARADHQKTLFWLPDHFSPCAASLRFDLDESVFILDALAQATRSETPVEVLAQQT

HGLASTLTRWAHYNALIRAFVPEASHRCGGQSANVEPRILVPITHNASYVVTHSPLPR

GIGYKLTGVDVRRPLFLTYLTATCEGSTRDIESKRLVRTQNQRDLGLVGAVFMRYTPA

GEVMSVLLVDTDNTQQQIAAGPTEGAPSVFSSDVPSTALLLFPNGTVIHLLAFDTQP

FIG. 214

Influenza virus H7 HA protein ectodomain (Type 1 protein)

MEKIVLLLAIVSLVKSDQICIGYHANNSTEQVDTIMEKNVTVTH

AQDILEKTHNGKLCDLNGVKPLILRDCSVAGWLLGNPMCDEFINVPEWSYIVEKASPA

NDLCYPGDFNDYEELKHLLSRTNHFEKIQIIPKSSWSNHDASSGVSSACPYHGRSSFF

RNVVWLIKKNSAYPTIKRSYNNTNQEDLLVLWGIHHPNDAAEQTKLYQNPTTYISVGT

STLNQRLVPEIATRPKVNGQSGRMEFFWTILKPNDAINFESNGNFIAPEYAYKIVKKG

DSAIMKSELEYGNCNTKCQTPMGAINSSMPFHNIHPLTIGECPKYVKSNRLVLATGLR

NTPQRERRRKKRGLFGAIAGFIEGGWQGMVDGWYGYHHSNEQGSGYAADKESTQKAID

GVTNKVNSIIDKMNTQFEAVGREFNNLERRIENLNKQMEDGFLDVWTYNAELLVLMEN

ERTLDFHDSNVKNLYDKVRLQLRDNAKELGNGCFEFYHKCDNECMESVKNGTYDYPQY

SEEARLNREEISGVKLESMGTYQ

FIG. 215

Influenza virus H9 protein ectodomain (Type 1 protein)

METISLITILLVVTASNADKICIGHQSTNSTETVDTLTETNVPV

THAKELLHTEHNGMLCATSLGHPLILDTCTIEGLVYGNPSCDLLLGGREWSYIVERSS

AVNGTCYPGNVENLEELRTLFSSASSYQRIQIFPDTTWNVTYTGTSRACSGSFYRSMR

WLTQKSGFYPVQDAQYTNNRGKSILFVWGIHHPPTYTEQTNLYIRNDTTTSVTTEDLN

RTFKPVIGPRPLVNGLQGRIDYYWSVLKPGQTLRVRSNGNLIAPWYGHVLSGGSHGRI

LKTDLKGGNCVVQCQTEKGGLNSTLPFHNISKYAFGTCPKYVRVNSLKLAVGLRNVPA

RSSRGLFGAIAGFIEGGWPGLVAGWYGFQHSNDQGVGMAADRDSTQKAIDKITSKVNN

IVDKMNKQYEIIDHEFSEVETRLNMINNKIDDQIQDVWAYNAELLVLLENQKTLDEHD

ANVNNLYNKVKRALGSNAMEDGKGCFELYHKCDDQCMETIRNGTYNRRKYREESRLER

QKIEGVKLESEGTYK

FIG. 216

Influenza Virus H5 protein ectodomain (Type 1 protein)

MEKIVLLLAIVSLVKSDQICIGYHANNSTEQVDTIMEKNVTVTH

AQDILEKTHNGKLCDLNGVKPLILRDCSVAGWLLGNPMCDEFINVPEWSYIVEKASPA

NDLCYPGDFNDYEELKHLLSRTNHFEKIQIIPKSSWSNHDASSGVSSACPYHGRSSFF

RNVVWLIKKNSAYPTIKRSYNNTNQEDLLVLWGIHHPNDAAEQTKLYQNPTTYISVGT

STLNQRLVPEIATRPKVNGQSGRMEFFWTILKPNDAINFESNGNFIAPEYAYKIVKKG

DSAIMKSELEYGNCNTKCQTPMGAINSSMPFHNIHPLTIGECPKYVKSNRLVLATGLR

NTPQRERRRKKRGLFGAIAGFIEGGWQGMVDGWYGYHHSNEQGSGYAADKESTQKAID

GVTNKVNSIIDKMNTQFEAVGREFNNLERRIENLNKQMEDGFLDVWTYNAELLVLMEN

ERTLDFHDSNVKNLYDKVRLQLRDNAKELGNGCFEFYHKCDNECMESVKNGTYDYPQY

SEEARLNREEISGVKLESMGTYQ

FIG. 217

Nipah virus F protein ectodomain (Type 1 protein)

MVVILDKRCYCNLLILILMISECSVGILHYEKLSKIGLVKGVTR

KYKIKSNPLTKDIVIKMIPNVSNMSQCTGSVMENYKTRLNGILTPIKGALEIYKNNTH

DLVGDVRLAGVIMAGVAIGIATAAQITAGVALYEAMKNADNINKLKSSIESTNEAVVK

LQETAEKTVYVLTALQDYINTNLVPTIDKISCKQTELSLDLALSKYLSDLLFVFGPNL

QDPVSNSMTIQAISQAFGGNYETLLRTLGYATEDFDDLLESDSITGQIIYVDLSSYYI

IVRVYFPILTEIQQAYIQELLPVSFNNDNSEWISIVPNFILVRNTLISNIEIGFCLIT

KRSVICNQDYATPMTNNMRECLTGSTEKCPRELVVSSHVPRFALSNGVLFANCISVTC

QCQTTGRAISQSGEQTLLMIDNTTCPTAVLGNVIISLGKYLGSVNYNSEGIAIGPPVF

TDKVDISSQISSMNQSLQQSKDYIKEAQRLLDTVNPSLIS

FIG. 218

Respiratory Syncytial virus F protein ectodomain (Type 1 protein)

MELLIHRLSAIFLTLAINALYLTSSQNITEEFYQSTCSAVSRGY

FSALRTGWYTSVITIELSNIKETKCNGTDTKVKLIKQELDKYKNAVTELQLLMQNTPA

ANNRARREAPQYMNYTINTTKNLNVSISKKRKRRFLGFLLGVGSAIASGIAVSKVLHL

EGEVNKIKNALLSTNKAVVSLSNGVSVLTSKVLDLKNYINNQLLPIVNQQSCRISNIE

TVIEFQQKNSRLLEINREFSVNAGVTTPLSTYMLTNSELLSLINDMPITNDQKKLMSS

NVQIVRQQSYSIMSIIKEEVLAYVVQLPIYGVIDTPCWKLHTSPLCTTNIKEGSNICL

TRTDRGWYCDNAGSVSFFPQADTCKVQSNRVFCDTMNSLTLPSEVSLCNTDIFNSKYD

CKIMTSKTDISSSVITSLGAIVSCYGKTKCTASNKNRGIIKTFSNGCDYVSNKGVDTV

SVGNTLYYVNKLEGKNLYVKGEPIINYYDPLVFPSDEFDASISQVNEKINQSLAFIRR

SDELLHNVNTGKSTTN

FIG. 219

Respiratory Syncytial virus F protein ectodomain (Type 1 protein)

MELLIHRLSAIFLTLAINALYLTSSQNITEEFYQSTCSAVSRGY
FSALRTGWYTSVITIELSNIKETKCNGTDTKVKLIKQELDKYKNAVTELQLLMQNTPA
ANNRARREAPQYMNYTINTTKNLNVSISKKRKRRFLGFLLGVGSAIASGIAVSKVLHL
EGEVNKIKNALLSTNKAVVSLSNGVSVLTSKVLDLKNYINNQLLPIVNQQSCRISNIE
TVIEFQQKNSRLLEINREFSVNAGVTTPLSTYMLTNSELLSLINDMPITNDQKKLMSS
NVQIVRQQSYSIMSIIKEEVLAYVVQLPIYGVIDTPCWKLHTSPLCTTNIKEGSNICL
TRTDRGWYCDNAGSVSFFPQADTCKVQSNRVFCDTMNSLTLPSEVSLCNTDIFNSKYD
CKIMTSKTDISSSVITSLGAIVSCYGKTKCTASNKNRGIIKTFSNGCDYVSNKGVDTV
SVGNTLYYVNKLEGKNLYVKGEPIINYYDPLVFPSDEFDASISQVNEKINQSLAFIRR
SDELLHNVNTGKSTTN

FIG. 220

SARS virus S glycoprotein ectodomain (Type 1 protein)

MFIFLLFLTLTSGSDLDRCTTFDDVQAPNYTQHTSSMRGVYYPDEIFRSDTLYLTQDLFL
PFYSNVTGFHTINHTFGNPVIPFKDGIYFAATEKSNVVRGWVFGSTMNNKSQSVIIINNST
NVVIRACNFELCDNPFFAVSKPMGTQTHTMIFDNAFNCTFEYISDAFSLDVSEKSGNFKH
LREFVFKNKDGFLYVYKGYQPIDVVRDLPSGFNTLKPIFKLPLGINITNFRAILTAFSPAQ
DIWGTSAAAYFVGYLKPTTFMLKYDENGTITDAVDCSQNPLAELKCSVKSFEIDKGIYQ
TSNFRVVPSGDVVRFPNITNLCPFGEVFNATKFPSVYAWERKKISNCVADYSVLYNSTFF
STFKCYGVSATKLNDLCFSNVYADSFVVKGDDVRQIAPGQTGVIADYNYKLPDDFMGC
VLAWNTRNIDATSTGNYNYKYRYLRHGKLRPFERDISNVPFSPDGKPCTPPALNCYWPL
NDYGFYTTTGIGYQPYRVVVLSFELLNAPATVCGPKLSTDLIKNQCVNFNFNGLTGTGV
LTPSSKRFQPFQQFGRDVSDFTDSVRDPKTSEILDISPCSFGGVSVITPGTNASSEVAVLYQ
DVNCTDVSTAIHADQLTPAWRIYSTGNNVFQTQAGCLIGAEHVDTSYECDIPIGAGICAS
YHTVSLLRSTSQKSIVAYTMSLGADSSIAYSNNTIAIPTNFSISITTEVMPVSMAKTSVDC
NMYICGDSTECANLLLQYGSFCTQLNRALSGIAAEQDRNTREVFAQVKQMYKTPTLKY
FGGFNFSQILPDPLKPTKRSFIEDLLFNKVTLADAGFMKQYGECLGDINARDLICAQKFN
GLTVLPPLLTDDMIAAYTAALVSGTATAGWTFGAGAALQIPFAMQMAYRFNGIGVTQN
VLYENQKQIANQFNKAISQIQESLTTTSTALGKLQDVVNQNAQALNTLVKQLSSNFGAIS
SVLNDILSRLDKVEAEVQIDRLITGRLQSLQTYVTQQLIRAAEIRASANLAATKMSECVL
GQSKRVDFCGKGYHLMSFPQAAPHGVVFLHVTYVPSQERNFTTAPAICHEGKAYFPRE
GVFVFNGTSWFITQRNFFSPQIITTDNTFVSGNCDVVIGIINNTVYDPLQPELDSFKEELDK
YFKNHTSPDVDLGDISGINASVVNIQKEIDRLNEVAKNLNESLIDLQELGKYEQYIK

FIG. 221

Varicella Zoster Virus gB protein ectodomain (Type 1 protein)

MFVTAVVSVS PSSFYESLQV EPTQSEDITR SAHLGDGDEI REAIHKSQDA
ETKPTFYVC\

PPTGSTIVRL EPTRTCPDYH LGKNFTEGIA VVYKENIAAY KFKATVYYKD
VIVSTAWAGS

SYTQITNRYA DRVPIPVSEI TDTIDKFGKC SSKATYVRNN HKVEAFNEDK
NPQDMPLIAS

KYNSVGSKAW HTTNDTYMVA GTPGTYRTGT SVNCIIEEVE ARSIFPYDSF
GLSTGDIIYM

SPFFGLRDGA YREHSNYAMD RFHQFEGYRQ RDLDTRALLE PAARNFLVTP
HLTVGWNWKP

KRTEVCSLVK WREVEDVVRD EYAHNFRFTM KTLSTTFISE TNEFNLNQIH
LSQCVKEEAR

AIINRIYTTR YNSSHVRTGD IQTYLARGGF VVVFQPLLSN SLARLYLQEL
VRENTNHSPQ

KHPTRNTRSR RSVPVELRAN RTITTTSSVE FAMLQFTYDH IQEHVNEMLA
RISSSWCQLQ

NRERALWSGL FPINPSALAS TILDQRVKAR ILGDVISVSN CPELGSDTRI
ILQNSMRVSG

STTRCYSRPL ISIVSLNGSG TVEGQLGTDN ELIMSRDLLE PCVANHKRYF
LFGHHYVYYE

DYRYVREIAV HDVGMISTYV DLNLTLLKDR EFMPLQVYTR DELRDTGLLD
YSEIQRRNQM

HSLRFYDIDK VVQYDSGTAI MQGMAQFFQG

FIG. 222

Varicella Zoster Virus gE protein ectodomain (Type 1 protein)

MFYEALKAELVYTRAVHGFRPRANCVVLSDYIPRVACNMGTVNK

PVVGVLMGFGIITGTLRITNPVRASVLRYDDFHTDEDKLDTNSVYEPYYHSDHAESSW

VNRGESSRKAYDHNSPYIWPRNDYDGFLENAHEHHGVYNQGRGIDSGERLMQPTQMSA

QEDLGDDTGIHVIPTLNGDDRHKIVNVDQRQYGDVFKGDLNPKPQGQRLIEVSVEENH

PFTLRAPIQRIYGVRYTETWSFLPSLTCTGDAAPAIQHICLKHTTCFQDVVVDVDCAE

NTKEDQLAEISYRFQGKKEADQPWIVVNTSTLFDELELDPPEIEPGVLKVLRTEKQYL

GVYIWNMRGSDGTSTYATFLVTWKGDEKTRNPTPAVTPQPRGAEFHMWNYHSHVFSVG

DTFSLAMHLQYKIHEAPFDLLLEWLYVPIDPTCQPMRLYSTCLYHPNAPQCLSHMNSG

CTFTSPHLAQRVASTVYQNCEHADNYTAYCLGISHMEPSFGLILHDGGTTLKFVDTPE

SLSGLYVFVVYFNGHVEAVAYTVVSTVDHFVNAIEERGFPPTAGQPPATTKPKEITPV

NPGTSPLLR

FIG. 223

Varicella Zoster Virus gI protein ectodomain (Type 1 protein)

MFLIHCLISA VIFYIQVTNA LIFKGDHVSL QVNSSLTSIL IPMQNDNYTE
IKGQLVFIGE

QLPTGTNYSG TLELLYADTV AFCFRSVQVI RYDGCPRIRT SAFISCRYKH
SWHYGNSTDR

ISTEPDAGVM LKITKPGIND AGVYVLLVRL DHSRSTDGFI LGVNVYTAGS
HHNIHGVIYT

SPSLQNGYST RALFQQARLC DLPATPKGSG TSLFQHMLDL RAGKSLEDNP
WLHEDVVTTE

TKSVVKEGIE NHVYPTDMST LPEKSLNDPP EN

FIG. 224

Influenza Virus Fujian strain NA protein ectodomain (Type 2 protein)

VTLHFKQYEFNSPPNNQVMLCEPTIIERNITEIVYLTNTTIEKEICPKLAEYRNWSKPQCNI
TGFAPFSKDNSIRLSAGGDIWVTREPYVSCDPDKCYQFALGQGTTLNNVHSNDTVHDRT
PYRTLLMNELGVPFHLGTKQVCIAWSSSSCHDGKAWLHVCVTGDDENATASFIYNGRL
VDSIVSWSKKILRTQESECVCINGTCTVVMTDGSASGKADTKILFIEEGKIVHTSTLSGSA
QHVEECSCYPRYPGVRCVCRDNWKGSNRPIVDINIKDYSIVSSYVCSGLVGDTPRKNDS
SSSSHCLDPNNEEGGHGVKGWAFDDGNDVWMGRTISEKLRSGYETFKVIEGWSNPNSK
LQINRQVIVDRGNRSGYSGIFSVEGKSCINRCFYVELIRGRKQETEVLWTSNSIVVFCGTS
GTYGTGSWPDGADINLMPI

FIG. 225

Metapneumovirus G protein ectodomain (Type 2 protein)

ESNEALSLCRIQGTPAPRDNKTNTENATKETTLHTTTTTRDPEVRETK

TTKPQANEGATNPSRNLTTKGDKHQTTRATTEAELEKQSKQTTEPGTSTQKHTPARPS

SKSPTTTQATAQPTTPTAPKASTAPKNRQATTKKTETDTTTASRARNTNNPTETATTT

PKATTETGKGKEGPTQHTTKEQPETTARETTTPQPRRTAGASPRAS

FIG. 226

Influenza Virus B NA protein ectodomain (Type 2 protein)

SDILLKFPSAEITAPTMPLDCANASNVQAVNRSATKGVTLLLPEPEWTYPRLSCPGSTFQ
EALLISPHRFGETKGNSAPLIIREPFIACGPKECKHFALTHYAAQPGGHYNGTRGDRNKL
RHLISVKLGKIPTVENSIFHMAAWSGSACHDGKEWTYIGVDGPDNNALLKIEYGEAYTD
TYHSYANNILRTQESACNCIGGNCYLMITDGSASGVSECRFLKIREGRIIKEIFPTGRIKHT
EECTCGFASNKTIECACRDNSYTAKRPFVKLNVETDTAEIRLMCTETYLDTPRPDDGSIT
GPCESNGDKGSGGIKGGFVHQRMASKIGRWYSRTMSKTKRMGMGLYVKYDGDPWAD
SDALAFSGVMVSMEEPGWYSFGFEIKDKKCDVPCIGIEMVHDGGKETWHSAATAIYCL
MGSGQLLWDTVTGVDMAL

FIG. 227

Human metapneumovirus G protein ectodomain (Type 2 protein)

NYTIQKTSSESEHHTSSPPTESNKEASTISTDNPDINPNSQHPTQQSTENP

TLNPAASVSPSETEPASTPDTTNRLSSVDRSTAQPSESRTKTKPTVHTRNNPSTASST

QSPPRATTKAIRRATTFRMSSTGKRPTTTSVQSDSSTTTQNHEETGSANPQASVSTMQN

FIG. 228

Human respiratory syncytial virus G protein ectodomain (Type 2 protein)

NHKVTLTTVTVQTIKNHTEKNITTYLTQVSPERVSPS

KQPTTTPPIHTNSATISPNTKSETHHTTAQTKGRTTTPTQNNKPSTKPRPKNPPKKPK

DDYHFEVFNFVPCSICGNNQLCKSICKTIPSNKPKKKPTIKPTNKPPTKTTNKRDSKT

LAKTLKKETTINPTKKPTPKTTERDTSTLQSIVLDTTTSKHTERDTSTSQSIVLDTTT

SKHTIQQQSLHSTTPENTPNSTQTPTASEPSTSNSNQKL

FIG. 229

Influenza virus N1 NA protein ectodomain (Type 2 protein)

SHSIQTGNQH

QAEPISNTNFLTEKAVASVTLAGNSSLCPISGWAVHSKDNSIRIGSKGDVFVIREPFI

SCSHLECRTFFLTQGALLNDKHSNGTVKDRSPHRTLMSCPVGEAPSPYNSRFESVAWS

ASACHDGTSWLTIGISGPDNGAVAVLKYNGIITDTIKSWRNNILRTQESECACVNGSC

FTVMTDGPSNGQASYKIFKMEKGKVVKSVELDAPNYHYEECSCYPDAGEITCVCRDNW

HGSNRPWVSFNQNLEYQIGYICSGVFGDNPRPNDGTGSCGPVSPNGAYGVKGFSFKYG

NGVWIGRTKSTNSRSGFEMIWDPNGWTGTDSSFSVKQDIVAITDWSGYSGSFVQHPEL

TGLDCIRPCFWVELIRGRPKESTIWTSGSSISFCGVNSDTVGWSWPDGAELPFTIDK

FIG. 230

Influenza virus N3 NA protein ectodomain (Type 2 protein)

NTVIHEKIGNHQT

VIHPTITTPAVPNCSDTIITYNNTVINNITTTIITEAERLFKPPLPLCPFRGFFPFHK

DNAIRLGENKDVIVTREPYVSCDNDNCWSFALAQGALLGTKHSNGTIKDRTPYRSLIR

FPIGTAPVLGNYKEICIAWSSSSCFDGKEWMHVCMTGNDNDASAQIIYAGRMTDSIKS

WRKDILRTQESECQCIGGTCVVAVTDGPAANSADHRVYWIREGRIVKYENVPKTKIQH

LEECSCYVDIDVYCICRDNWKGSNRPWMRINNETILETGYVCSKFHSDTPRPADPSTV

SCDSPSNINGGPGVKGFGFKAGNDVWLGRTVSTSGRSGFEIIKVTDGWINSPNHAKSV

TQTLVSNNDWSGYSGSFIVKTKGCFQPCFYVELIRGRPNKNDDVSWTSNSIVTFCGLD

NEPGSGNWPDGSNIGFMPK

FIG. 231

Influenza virus N2 NA protein ectodomain (Type 2 protein)

KQYECNS

PPNNQVMLCEPTIIERNITEIVYLTNTTIEKEICPKLAEYRNWSKPQCNITGFAPFSK

DNSIRLSAGGDIWVTREPYVSCDPDKCYQFALGQGTTLNNGHSNDTVHDRTPYRTLLM

NELGVPFHLGTKQVCIAWSSSSCHDGKAWLHVCVTGDDENATASFIYNGRLVDSIGSW

SKKILRTQESECVCINGTCTVVMTDGSASGKADTKILFIEEGKIVHTSLLSGSAQHVE

ECSCYPRYPGVRCVCRDNWKGSNRPIVDINVKDYSIVSSYVCSGLVGDTPRKNDSSSS

SHCLDPNNEEGGHGVKGWAFDDGNDVWMGRTISEKLRSGYETFKVIEGWSKPNSKLQI

NRQVIVDRGNRSGYSGIFSVEGKSCINRCFYVELIRGRKQETEVLWTSNSIVVFCGTS

GTYGTGSWPDGADINLMPI

FIG. 232

Measles virus HA protein ectodomain (Type 2 protein)

RLHRAAIYTAENHKSLSTNLDVTNSIEHQVKDVLTPLFKIIGDE

VGLRTPQRFTDLVKFISDKIKFLNPDREYDFRDLTWCINPPERIKLDYDQYCADVAAE

ELMNALVNSTLLEARATNQFLAVSKGNCSGPTTIRGQFSNMSLSLLDLYLSRGYNVSS

IVTMTSQGMYGGTYLVEKPNLSSKGSELSQLSMHRVFEVGVIRNPGLGAPVFHMTNYF

EQPVSNDFSNCMVALGELKFAALCHREDSITIPYQGSGKGVSFQLVKLGVWKSPTDMR

SWVPLSTDDPVIDRLYLSSHRGVIADNQAKWAVPTTRTDDKLRMETCFQQACKGKNQA

LCENPEWAPLKDNRIPSYGVLSVNLSLTVELKIKIASGFGPLITHGSGMDLYKTNHNN

VYWLTIPPMKNLALGVINTLEWIPRFKVSPNLFTVPIKEAGEDCHAPTYLPAEVDGDV

KLSSNLVILPGQDLQYVLATYDTSRVEHAVVYYVYSPSRSFSYFYPFRLPIKGVPIEL

QVECFTWDKKLWCRHFCVLADSESGGHITHSGMVGMGVSCTVTREDGTNRR

FIG. 233

Mumps virus HN protein ectodomain (Type 2 protein)

ELIRMINDQGLSNQLSSITDKIRESAAMIASAVGVMNQVIHGVTVSLPL

QIEGNQNQLLSTLATICTNRNQVSNCSTNIPLVNDLRFINGINKFIIEDYATHDFSIG

HPLNMPSFIPTATSPNGCTRIPSFSLGKTHWCYTHNVINANCKDHTSSNQYVSMGILV

QTASGYPMFKTLKIQYLSDGLNRKSCSIATVPDGCAMYCYVSTQLETDDYAGSSPPTQ

KLTLLFYNDTIKERTISPSGLEGNWATLVPGVGSGIYFENKLIFPAYGGVLPNSTLGV

KSAREFFRPVNPYNPCSGPPQELDQRALRSYFPSYFSSRRVQSAFLVCAWNQILVTNC

ELVVPSNNQTLMGAEGRVLLINNRLLYYQRSTSWWPYELLYEISFTFTNSGQSSVNMS

WIPIYSFTRPGLGKCSGENICPTVCVSGVYLDPWPLTPYSHQSGINRNFYFTGALLNS

STTRVNPTLYVSALNNLKVLAPYGTQGLFASYTTTTCFQDTGDASVYCVYIMELASNI

VGEFQILPVLARLTIT

FIG. 234

Nipah virus G protein ectodomain (Type 2 protein)

NYTRSTDNQAVIKDALQGIQQQIKGLADKIG

TEIGPKVSLIDTSSTITIPANIGLLGSKISQSTASINENVNEKCKFTLPPLKIHECNI

SCPNPLPFREYRPQTEGVSNLVGLPNNICLQKTSNQILKPKLISYTLPVVGQSGTCIT

DPLLAMDEGYFAYSHLERIGSCSRGVSKQRIIGVGEVLDRGDEVPSLFMTNVWTPPNP

NTVYHCSAVYNNEFYYVLCAVSTVGDPILNSTYWSGSLMMTRLAVKPKSNGGGYNQHQ

LALRSIEKGRYDKVMPYGPSGIKQGDTLYFPAVGFLVRTEFKYNDSNCPITKCQYSKP

ENCRLSMGIRPNSHYILRSGLLKYNLSDGENPKVVFIEISDQRLSIGSPSKIYDSLGQ

PVFYQASFSWDTMIKFGDVLTVNPLVVNWRNNTVISRPGQSQCPRFNTCPEICWEGVY

NDAFLIDRINWISAGVFLDSNQTAENPVFTVFKDNEILYRAQLASEDTNAQKTITNCF

LLKNKIWCISLVEIYDTGDNVIRPKLFAVKIPEQCT

FIG. 235

Parainfluenza 2 virus HN protein ectodomain (Type 2 protein)

KIDSIETVIFSA

LKDMHTGSMSNTNCTPGNLLLHDAAYINGINKFLVLKSYNGTPKYGPLLNIPSFIPSA

TSPNGCTRIPSFSLIKTHWCYTHNVMLGDCLDFTTSNQYLAMGIIQQSAAAFPIFRTM

KTIYLSDGINRKSCSVTAIPGGCVLYCYVATRSEKEDYATTDLAELRLAFYYYNDTFI

ERVISLPNTTGQWATINPAVGSGIYHLGFILFPVYGGLISGTPSYNKQSSRYFIPKHP

NITCAGNSSEQAAAARSSYVIRYHSNRLIQSAVLICPLSDMHTARCNLVMFNNSQVMM

GAEGRLYVIDNNLYYYQRSSSWWSASLFYRINTDFSKGIPPIIEAQWVPSYQVPRPGV

MPCNATSFCPANCITGVYADVWPLNDPEPTSQNALNPNYRFAGAFLRNESNRTNPTFY

TASASALLNTTGFNNTNHKAAYTSSTCFKNTGTQKIYCLIIEMGSSLLGEFQIIPFL

RELIP

FIG. 236

Parainfluenza virus 3 HN protein ectodomain (Type 2 protein)

DLIIKQDTCMKTNIMTVSSMNESAKIIKETITELIRQEVISRTINI

QSSVQSGIPILLNKQSRDLTQLIEKSCNRQELAQICENTIAIHHADGISPLDPHDFWR

CPVGEPLLSNNPNISLLPGPSLLSGSTTISGCVRLPSLSIGDAIYAYSSNLITQGCAD

IGKSYQVLQLGYISLNSDMYPDLNPVISHTYDINDNRKSCSVIAAGTRGYQLCSLPTV

NETTDYSSEGIEDLVFDILDLKGKTKSHRYKNEDITFDHPFSAMYPSVGSGIKIENTL

IFLGYGGLTTPLQGDTKCVINRCTNVNQSVCNDALKITWLKKRQVVNVLIRINNYLSD

RPKIVVETIPITQNYLGAEGRLLKLGKKIYIYTRSSGWHSNLQIGSLDINNPMTIKWA

PHEVLSRPGNQDCNWYNRCPRECISGVYTDAYPLSPDAVNVATTTLYANTSRVNPTIM

YSNTSEIINMLRLKNVQLEAAYTTTSCITHFGKGYCFHIVEINQASLNTLQPMLFKTS

IPKICKITS

FIG. 237

Vaccinia virus surface protein ectodomain (Type 2 protein)

DIENEITEFFNKMRDTLPAK

DSKWLNPACMFGGTMNDIAALGEPFSAKCPPIEDSLLSHRYKDYVVKWERLEKNRRRQ

VSNKRVKHGDLWIANYTSKFSNRRYLCTVTTKNGDCVQGIVRSHIKKPPSCIPKTYEL

GTHDKYGIDLYCGILYAKHYNNITWYKDNKEINIDDIKYSQTGKKLIIHNPELEDSGR

YNCYVHYDDVRIKNDIVVSRCKILTVIPSQDHRFKLILDPKINVTIGEPANITCTAVS

TSLLIDDVLIEWENPSGWLIGFDFDVYSVLTSRGGITEATLYFENVTEEYIGNTYKCR

GHNYYFEKTLTTTVVLE

FIG. 238

Prion protein ectodomains (Type 3 protein)

(A)

MANLGCWMLVLFVATWSDLGLCKKRPKPGGWNTGGSRYPGQGSPGGNRYPPQGGGG
WGQPHGGGWGQPHGGGWGQPHGGGWGQPHGGGWGQGGGTHSQWNKPSK (B)

SRPIIHFGSDYEDRYYRENMHRYPNQVYYRPMDEYSNQNNFVHDCVNITIKQHTVTTTT
KGENFTETDVKMMERVVEQMCITQYERESQAYYQRGSS

FIG. 239

Hepatitis B virus L form of HBsAg protein ectodomain (Type 3 protein)

MGLSWTVPLEWGKNLSTSNPLGFLPDHQLDPAFRANTNNPDWDFNPKKDPWPEANKV
GVGAYGPGFTPPHGGLLGWSPQSQGTLTTLPADPPPASTNRQSGRQPTPISPPLRDSH
PQAMQWNSTAFHQALQNPKVRGLYFPAGGSSSGIVNPVPTIASHISSIFSRI
GDPAPNMENITSG

FIG. 240

VIRUS-LIKE PARTICLES AS VACCINES FOR PARAMYXOVIRUS

This application is a continuation-in-part of, and claims priority to, U.S. patent application Ser. No. 11/497,888, filed Aug. 2, 2006, now U.S. Pat. No. 7,951,384, which claims priority to provisional U.S. Application No. 60/706,126, filed Aug. 5, 2005, now abandoned, the contents of each of which are incorporated herein in their entirety.

STATEMENT OF GOVERNMENT SUPPORT

This invention was made with government support under grant number AI030572 awarded by the National Institutes of Health.

SEQUENCE LISTING

A Sequence Listing has been submitted on a compact disc, the entire content of which is herein incorporated by reference. The compact disc and its duplicate are labeled Copy 1 and Copy 2, respectively. Each disk contains a file name "13588seq.txt" created on May 23, 2008 that is 860,160 bytes, and each disk is identical to the other.

FIELD OF INVENTION

The present invention relates to the field of viral vaccines. In one embodiment, the present invention contemplates a paramyxoviral vaccine effective against diseases such as, but not limited to, Newcastle disease, measles, parainfluenza virus 3, and respiratory syncytial virus. In one embodiment, the present invention contemplates a vaccine comprising Newcastle disease virus (NDV)-like particles (VLP). In one embodiment, the present invention contemplates a method comprising transfecting avian cells with cDNAs encoding major NDV structural proteins. In another embodiment, a method wherein particles resembling infectious virions are released with nearly 100% efficiency. In one embodiment, the particles are non-infectious and provide a safe and effective NDV vaccine.

The invention further provides expression vectors that contain Newcastle disease virus nucleotide sequences that are useful for expression of proteins of interest, such as membrane proteins, soluble proteins, epitopes, and the like. The invention also provides methods for using these vectors to produce virus-like particles (VLPs) that contain the proteins of interest. Also provided are methods for using the virus-like particles (VLPs) for immunizing animals against a protein of interest.

BACKGROUND

Over the last decade, a number of concerns have arisen related to safety issues regarding paramyxovirus vaccines that have had an adverse effect on the public's trust. These concerns affect not only parents whose children are the primary recipient of childhood disease vaccines, but also ranchers devoted to raising animals susceptible to various types of paramyxoviruses.

Historically, Newcastle disease has been a devastating disease of poultry, and in many countries the disease remains one of the major problems affecting existing or developing poultry industries. Even in countries where Newcastle disease may be considered to be controlled, an economic burden is still associated with vaccination and/or maintaining strict biosecurity measures. The variable nature of Newcastle disease virus strains in terms of virulence for poultry and the different susceptibilities of the different species of birds mean that for control and trade purposes, Newcastle disease requires careful definition. Confirmatory diagnosis of Newcastle Disease requires the isolation and characterization of the virus involved. Currently Newcastle disease control is limited to prevention of introduction and spread, good biosecurity practices and/or live attenuated virus vaccination. Newcastle disease viruses may infect humans, usually causing transient conjunctivitis, but human-to-human spread has never been reported. Alexander D. J., "Newcastle disease and other avian paramyxoviruses" Rev Sci Tech. 19(2):443-62 (2000).

Historically, the live attenuated measles virus (MV) vaccine and the combination multivalent measles, mumps, and rubella (MMR) vaccine have had a positive impact on the health of children worldwide by preventing infectious disease. The induction of an effective antiviral immune response using these live attenuated virus vaccines, however, are known to result in a significant rate of adverse events (i.e., for example, autism). Kennedy et al., "Measles virus infection and vaccination: potential role in chronic illness and associated adverse events" Crit. Rev Immunol. 24(2):129-56 (2004).

Healthy, and at risk, children are susceptible to the morbidity and mortality associated with viral-induced respiratory diseases, including respiratory syncytial virus (RSV) and influenza. Currently, the World Health Organization is attempting to develop and distribute effective vaccines to prevent/reduce key viral respiratory diseases. The progress, however, is slow and the risk/benefit ratio is high. A vaccination program for viral respiratory infections should include the prevention of lower respiratory tract infections and prevention of infection-associated morbidities, hospitalization and mortality. Presently, there are two influenza vaccines; i) a trivalent inactivated vaccine, and ii) a live, cold-adapted, attenuated vaccine. Compliancy, however, is relatively low (i.e., 10-30%). Because it is believed that the low compliancy is related to the known high risk of contaminated vaccines, those in the art recommend that research should continue into safe and effective vaccines for all childhood viral illnesses. Greenberg et al., "Immunization against viral respiratory disease: A review" Pediatr Infect Dis J. 23(11 Suppl):S254-61 (2004).

What is needed in the art is a low risk, highly effective paramyxovirus vaccine that is compatible with population-wide distribution marketing goals of low cost and high production rates.

SUMMARY

The present invention relates to the field of viral vaccines. In one embodiment, the present invention contemplates a paramyxoviral vaccine effective against diseases such as, but not limited to, Newcastle disease, measles, parainfluenza virus 3, and respiratory syncytial virus. In one embodiment, the present invention contemplates a vaccine comprising Newcastle disease virus-like particles (VLP). In one embodiment, the present invention contemplates a method comprising transfecting avian cells with cDNAs encoding major NDV structural proteins. In another embodiment, a method wherein particles resembling infectious virions are released with nearly 100% efficiency. In one embodiment, the particles are non-infectious and provide a safe and effective NDV vaccine.

In one embodiment, the present invention contemplates a method, comprising; a) providing, i) an expression vector comprising DNA sequences encoding a Newcastle disease matrix protein; ii) a cell capable of being transfected by said vector; b) transfecting said cell with said vector under conditions such that Newcastle disease virus-like particles are generated. In one embodiment, the method further comprises the step c) harvesting said virus-like particles so as to create a cell-free preparation of particles. In one embodiment, the method further comprises the step d) administering a vaccine comprising said preparation of particles to a chicken. In one embodiment, the cell is part of a cell culture and said harvesting comprises obtaining said particles from the supernatant of said culture. In one embodiment, the cell culture comprises sub-confluent avian cells. In one embodiment, the vector further comprises DNA sequences encoding additional Newcastle disease viral proteins selected from the group consisting of a nucleocapsid protein, a fusion protein, and a hemagglutinin-neuraminidase protein. In one embodiment, the particles are free of Newcastle disease viral DNA.

In one embodiment, the present invention contemplates a transfected cell comprising an expression vector comprising DNA sequences encoding a Newcastle disease matrix protein capable of generating Newcastle disease virus-like particles.

In one embodiment, the present invention contemplates a cell-free preparation of virus like particles harvested from a transfected cell comprising an expression vector comprising DNA sequences encoding a Newcastle disease matrix protein capable of generating Newcastle disease virus-like particles.

In one embodiment, the present invention contemplates a method, comprising; a) providing, i) a vaccine comprising Newcastle disease virus-like particles, said particles comprising a Newcastle disease viral matrix protein; ii) a host susceptible to Newcastle disease; b) immunizing said host with said vaccine under conditions such that antibodies directed to said virus-like particle are produced. In one embodiment, the host is selected from the group consisting of avian, murine, and human. In one embodiment, the particles further comprise one or more additional Newcastle disease viral proteins selected from the group consisting of a fusion protein, a nucleocapsid protein and a hemagglutinin-neuraminidase protein.

In one embodiment, the present invention contemplates a vaccine comprising Newcastle disease virus-like particles, said particles comprising a Newcastle disease viral matrix protein. In one embodiment, the particles are free of Newcastle disease viral DNA. In one embodiment, the particles further comprise one or more additional viral proteins selected from the group consisting of a fusion protein, nucleocapsid protein and a hemagglutinin-neuraminidase protein.

In one embodiment, the present invention contemplates a vaccine comprising a Newcastle disease virus-like particle and a Newcastle disease matrix protein. In one embodiment, the vaccine further comprises at least two viral glycoproteins. In one embodiment, the glycoproteins are selected from the group consisting of a fusion protein and a hemagglutinin-neuraminidase protein. In one embodiment, the vaccine further comprises a nucleocapsid protein. In one embodiment, the matrix protein comprises a Late Domain. In one embodiment, the Late Domain comprises an FPIV sequence (SEQ ID NO:1). In one embodiment, the Late Domain comprises a PXXP sequence (SEQ ID NO:2). In one embodiment, the Late Domain comprises an YXXL sequence (SEQ ID NO:3). In one embodiment, the vaccine is non-infectious.

One embodiment of the present invention contemplates an avian vaccine comprising a Newcastle disease virus-like particle and a Newcastle disease matrix protein. In one embodiment, the vaccine further comprises at least two viral glycoproteins. In one embodiment, said glycoproteins are selected from the group comprising a fusion protein and a hemagglutinin-neuraminidase protein. In one embodiment, the vaccine further comprises a nucleocapsid protein. In one embodiment, said virus-like particle comprises a Paramyxovirus virus-like particle. In one embodiment, said Paramyxovirus virus-like particle comprises a Newcastle disease virus-like particle. In one embodiment, said matrix protein comprises a Late Domain. In one embodiment, said Late Domain comprises an FPIV sequence (SEQ ID NO:1). In one embodiment, said Late Domain comprises a PXXP sequence (SEQ ID NO:2). In one embodiment, said Late Domain comprises an YXXL sequence (SEQ ID NO:3). In one embodiment, said virus-like particle is non-infectious.

In one embodiment, the present invention contemplates a method, comprising; a) providing, i) an expression vector comprising cDNA sequences encoding a Newcastle disease virus matrix protein and at least two viral glycoproteins; ii) a cell capable of being transfected by said vector; b) transfecting said cell by said vector under conditions that generate a Newcastle disease virus-like particle, wherein said particle comprises said matrix protein. In one embodiment, the cell comprises sub-confluent avian cells. In one embodiment, the expression vector comprises pCAGGS. In one embodiment, the glycoproteins are selected from the group consisting of a fusion protein and a hemagglutinin-neuraminidase protein. In one embodiment, the expression vector further comprises a cDNA sequence encoding a nucleocapsid protein. In one embodiment, the method further comprises releasing said virus-like particle at an efficiency of at least 85%. In one embodiment, the virus-like particle further comprises said at least two viral glycoproteins.

One embodiment of the present invention contemplates a method, comprising; a) providing, i) an expression vector comprising cDNA sequences encoding a Newcastle disease virus matrix protein and at least two viral glycoproteins; ii) a cell capable of being transfected by said vector; and b) transfecting said cell by said vector under conditions that generate an avian vaccine comprising a virus-like particle. In one embodiment, said cell comprises sub-confluent avian cells. In one embodiment, said cell comprises human cells. In one embodiment, said expression vector comprises pCAGGS. In one embodiment, said glycoproteins are selected from the group comprising a fusion protein and a hemagglutinin-neuraminidase protein. In one embodiment, the vector further comprises a cDNA sequence encoding a nucleocapsid protein. In one embodiment, the method further comprises releasing said virus-like particle at an efficiency of at least 85%. In one embodiment, said virus-like particle comprises said matrix protein and said at least two viral glycoproteins.

In one embodiment, the present invention contemplates a method, comprising; a) providing, i) a vaccine comprising a Newcastle disease virus-like particle and a Newcastle disease virus matrix protein and at least two viral glycoproteins; ii) a host capable of immunization by said virus-like particle; b) immunizing said host by said virus-like particle under conditions such that antibodies directed to said virus-like particle are produced. In one embodiment, the host is selected from the group consisting of avian, murine, and human. In one embodiment, the glycoproteins are selected from the group consisting of a fusion protein, and a hemagglutinin-neuraminidase protein. In one embodiment, the vaccine further comprises a nucleocapsid protein.

One embodiment of the present invention contemplates a method, comprising; a) providing, i) an avian vaccine comprising a Newcastle disease virus virus-like particle, a Newcastle disease virus matrix protein and at least two viral glycoproteins; ii) a host capable of immunization by said virus-like particle; b) immunizing said host by said vaccine under conditions such that antibodies directed to said virus-like particle are produced. In one embodiment, said host is selected from the group comprising avian, murine, and human. In one embodiment, said virus-like particle comprises a Newcastle disease virus-like particle. In one embodiment, said glycoproteins are selected from the group comprising a fusion protein, and a hemagglutinin-neuraminidase protein. In one embodiment, the vaccine further comprises a nucleocapsid protein.

In one embodiment, the present invention contemplates an VLP vaccine expression system comprising a first cDNA encoding a first viral protein from a first Newcastle disease virus strain; a second cDNA encoding a second viral protein from a second Newcastle disease virus strain; and a third cDNA encoding a third viral protein from a third strain. In one embodiment, the first viral protein is selected from the group comprising HN protein, F protein, NP protein or M protein. In one embodiment, the first strain is selected from the group comprising strain Hertz, strain AV, or strain B1. In one embodiment, the second viral protein gene is selected from the group comprising HN protein, F protein, NP protein or M protein. In one embodiment, the second strain is selected from the group comprising strain Hertz, strain AV, or strain B1. In one embodiment, the third viral protein is selected from the group comprising HN protein, F protein, NP protein or M protein. In one embodiment, the third strain is selected from the group comprising strain Hertz, strain AV, or strain B1. In one embodiment, the present invention contemplates a method for detecting a viral protein and/or gene incorporated into a VLP vaccine comprising contacting the viral protein gene with strain specific antibodies or incorporated sequence tags.

The invention provides a expression vector comprising, in operable combination: a) a first nucleic acid sequence encoding a Newcastle Disease Virus matrix (M) protein, b) a second nucleic acid sequence encoding a transmembrane domain (TM) protein, c) a third nucleic acid sequence encoding Newcastle Disease Virus cytoplasmic domain (CT) protein, and d) a fourth nucleic acid sequence encoding a protein of interest or portion thereof, wherein the second nucleic acid sequence is flanked by the third and fourth nucleic acid sequences. Without intending to limit the number of nucleotides between the second and fourth sequence, and between the second and third sequences, in one embodiment, the vector further comprises from 0 to 30 nucleotides between the second and fourth nucleic acid sequences. In another embodiment, the vector further comprises from 0 to 3 nucleotides between the second and fourth nucleic acid sequences. In yet a further embodiment, the vector further comprises from 0 to 10 nucleotides between the second and third nucleic acid sequences.

While not intending to limit the source of the second nucleotide sequence encoding the transmembrane domain (TM) protein, in one embodiment, the second nucleic acid sequence encodes one or more Newcastle Disease Virus fusion (F) protein transmembrane domain (TM) protein. In another embodiment, the second nucleic acid sequence encodes one or more Newcastle Disease Virus heamagglutinin-neuraminidase (HN) protein transmembrane domain (TM) protein. In yet another alternative embodiment, the second nucleic acid sequence encodes one or more transmembrane domain (TM) protein selected from the group exemplified by the transmembrane domain of influenza virus HA protein, influenza virus NA protein, G protein-coupled receptor, leucine zipper EF hand receptor, *Escherichia coli* LipoF protein, *Escherichia coli* OmpF protein, *Escherichia coli* OmpA protein, human T cell receptor a chain, HLA class I protein, human MHC HLA-G protein, squalene synthetase, CD4 protein, and CD8 protein.

Without limiting the source of the third nucleotide sequence encoding the cytoplasmic domain (CT) protein, in one embodiment, the third nucleic acid sequence encodes a Newcastle Disease Virus fusion (F) protein cytoplasmic domain (CT) protein. In another embodiment, the third nucleic acid sequence encodes a Newcastle Disease Virus heamagglutinin-neuraminidase (HN) protein cytoplasmic domain (CT) protein.

To illustrate, but not limit, the source of the protein of interest, in one embodiment, the protein of interest comprises a membrane protein. In another embodiment, the membrane protein is selected from the group exemplified in Tables 6-11. In an alternative embodiment, the protein of interest comprises an ectodomain of a membrane protein. In yet another embodiment, the ectodomain is selected from the group exemplified in Tables 7, 9 and 11, and in U.S. Pat. Nos. 7,262,270; 7,253,254; 7,250,171; 7,223,390; 7,189,403; 7,122,347; 7,119,165; 7,101,556; 7,067,110; 7,060,276; 7,029,685; 7,022,324; 6,946,543; 6,939,952; 6,713,066; 6,699,476; 6,689,367; 6,566,074; 6,531,295; 6,417,341; 6,248,327; 6,140,059; 5,851,993; 5,847,096; 5,837,816; 5,674,753; and 5,344,760.

In one embodiment, the membrane protein comprises a type 1 protein. In another embodiment, the type 1 protein is selected from the group exemplified in Table 6. In a further embodiment, the protein of interest comprises an ectodomain of a type 1 protein. In yet another embodiment, the ectodomain of a type 1 protein is selected from the group exemplified in Table 7. In a further embodiment, the ectodomain comprises SEQ ID NO:251.

In an alternative embodiment, the membrane protein comprises a type 2 protein. In another embodiment, the type 2 protein is selected from the group exemplified in Table 8. In a further embodiment, the protein of interest comprises an ectodomain of a type 2 protein. In yet another embodiment, the ectodomain of a type 2 protein is selected from the group exemplified in Table 9. In a particular embodiment, the ectodomain comprises SEQ ID NO: 270.

In another alternative embodiment, the membrane protein comprises a type 3 protein. In one embodiment, the type 3 protein is selected from the group exemplified in Table 10. In an alternative embodiment, the protein of interest comprises an ectodomain of a type 3 protein. In a further embodiment, the ectodomain of a type 3 protein is selected from the group exemplified in Table 11.

In another example, and without limiting, the source of the protein of interest, in one embodiment, the protein of interest comprises a soluble protein. In one embodiment, the soluble protein is selected from the group exemplified in Table 12.

Also without limiting the source of the protein of interest, in one embodiment, the protein of interest comprises an epitope. In one embodiment, the epitope is selected from the group exemplified by YPYDVPDYA (SEQ ID NO: 227), EphrinA2 epitopes, hepatitis C virus epitopes, vaccinia virus epitopes, dog dander epitopes, human papilloma virus (HPV) epitopes, *Mycobacterium tuberculosis* epitopes, bacterial meningitis epitopes, malaria epitopes, and type 1 diabetes mellitus epitopes.

In one embodiment for expressing, for example, type 1 proteins, type 3 proteins, soluble proteins, and epitopes, the third nucleic acid sequence encodes a Newcastle Disease Virus fusion (F) protein cytoplasmic domain (CT) protein, and wherein the fourth nucleic acid sequence encodes a type 1 protein, type 3 protein, soluble protein, and/or epitopes. In another embodiment, the second nucleic acid sequence encodes a Newcastle Disease Virus fusion (F) protein transmembrane domain (TM) protein. In yet a further embodiment, the vector further comprises Newcastle Disease Virus nucleocapsid (NP) protein. In an alternative embodiment, the vector further comprises Newcastle Disease Virus fusion (F) protein. In another alternative, the vector further comprises Newcastle Disease Virus heamagglutinin-neuraminidase (HN) protein.

In another embodiment for expressing, for example, type 2 proteins, type 3 proteins, soluble proteins, and epitopes, the third nucleic acid sequence encodes a Newcastle Disease Virus heamagglutinin-neuraminidase (HN) protein cytoplasmic domain (CT) protein, and wherein the fourth nucleic acid sequence encodes a type 2 protein, type 3 protein, soluble protein, and/or epitope. In one embodiment, the second nucleic acid sequence encodes a Newcastle Disease Virus heamagglutinin-neuraminidase (HN) protein transmembrane domain (TM) protein. In a further embodiment, the vector further comprises Newcastle Disease Virus nucleocapsid (NP) protein. In yet another embodiment, the vector further comprises Newcastle Disease Virus fusion (F) protein. In an alternative embodiment, the vector further comprises Newcastle Disease Virus fusion (F) protein and Newcastle Disease Virus heamagglutinin-neuraminidase (HN) protein.

In a further embodiment for expressing, for example and without limitation, soluble proteins, type 3 proteins, and epitopes, in one embodiment, the second nucleic acid sequence encodes a Newcastle Disease Virus fusion (F) protein transmembrane domain (TM) protein, and wherein the third nucleic acid sequence encodes a Newcastle Disease Virus fusion (F) protein cytoplasmic domain (CT) protein. In an alternative embodiment, the second nucleic acid sequence encodes a Newcastle Disease Virus heamagglutinin-neuraminidase (HN) protein transmembrane domain (TM) protein, and wherein the third nucleic acid sequence encodes a Newcastle Disease Virus heamagglutinin-neuraminidase (HN) protein cytoplasmic domain (CT) protein.

Without limiting the sequence of the Newcastle Disease Virus matrix (M) protein used in the invention's vectors, in one embodiment, the Newcastle Disease Virus matrix (M) protein is selected from the group of sequences exemplified in Table 13.

The invention also provides a cell comprising any of the vectors disclosed herein. In one embodiment, the cell is selected from avian cell, insect cell, and mammalian cell. In another embodiment, the avian cell is an ELL-0 cell (East Lansing Strain of Chicken embryo fibroblast) or an egg cell. In a further embodiment, the insect cell is selected from the group exemplified by *Trichoplusia ni* (Tn5) cell and SF9 cell. In a further embodiment, the mammalian cell is selected from the group exemplified by Chinese hamster ovary CHO-K1 cells, bovine mammary epithelial cells, monkey COS-7 cells, human embryonic kidney 293 cells, baby hamster kidney (BHK) cells, mouse sertoli TM4 cells, monkey kidney CV1 cells, African green monkey kidney VERO-76 cells, human cervical carcinoma HELA cells, canine kidney MDCK cells, buffalo rat liver BRL 3A cells, human lung W138 cells, human liver Hep G2 cells, mouse mammary tumor (MMT) cells, TR1 cells, MRC 5 cells, FS4 cells, rat fibroblasts 208F cells, an bovine kidney MDBK cells. The cell may be in vitro or in vivo.

The invention additionally provides recombinant virus-like particle (VLP) produced by expression of any of the vectors disclosed herein. In one embodiment, the recombinant virus-like particle (VLP) comprises: a) a Newcastle disease virus matrix (M) protein, b) a transmembrane domain (TM) protein, c) a Newcastle Disease Virus cytoplasmic domain (CT) protein, and d) a protein of interest, wherein the transmembrane (TM) protein is flanked by the cytoplasmic domain (CT) protein and the protein of interest. In one embodiment, the virus-like particle (VLP) is purified. In another embodiment, the protein of interest is expressed on the outside surface of the virus-like particle (VLP). In a further embodiment, the virus-like particle (VLP) is immunogenic.

While not intending to limit the source or type of transmembrane (TM) protein, in one embodiment, the transmembrane (TM) protein comprises a Newcastle Disease Virus fusion (F) protein transmembrane domain (TM) protein. In an alternative embodiment, the transmembrane (TM) protein comprises a Newcastle Disease Virus heamagglutinin-neuraminidase (HN) protein transmembrane domain (TM) protein. In a further embodiment, the transmembrane (TM) protein comprises a sequence exemplified by those discussed supra, and herein.

Also without intending to limit the source or type of cytoplasmic domain (CT) protein, in one embodiment, the cytoplasmic domain (CT) protein comprises a Newcastle Disease Virus fusion (F) protein cytoplasmic domain (CT) protein. In an alternative embodiment, the cytoplasmic domain (CT) protein comprises Newcastle Disease Virus heamagglutinin-neuraminidase (HN) protein cytoplasmic domain (CT) protein. In a further embodiment, the cytoplasmic domain (CT) protein comprises a sequence exemplified by those discussed supra, and herein.

To illustrate, but not limit, the source and type of Newcastle disease virus matrix (M) protein and protein of interest, these proteins are exemplified by those discussed supra, and herein.

In one embodiment, such as where the invention's virus-like particles (VLPs) contain a type 1 protein, type 3 protein, soluble protein, and/or epitope, the VLP contains a Newcastle Disease Virus fusion (F) protein cytoplasmic domain (CT) protein. In another embodiment, the VLP further comprises a Newcastle Disease Virus fusion (F) protein transmembrane domain (TM) protein. In a further embodiment, the VLP further comprises Newcastle Disease Virus nucleocapsid (NP) protein. In an alternative embodiment, the VLP further comprises Newcastle Disease Virus fusion (F) protein. In yet another embodiment, the VLP further comprises Newcastle Disease Virus heamagglutinin-neuraminidase (HN) protein.

In one embodiment, such as where the invention's virus-like particles (VLPs) contain a type 2 protein, type 3 protein, soluble protein, and/or epitope, the VLP contains a Newcastle Disease Virus heamagglutinin-neuraminidase (HN) protein cytoplasmic domain (CT) protein. In a further embodiment, the VLP further contains a Newcastle Disease Virus heamagglutinin-neuraminidase (HN) protein transmembrane domain (TM) protein. In yet another embodiment, the VLP further comprises Newcastle Disease Virus nucleocapsid (NP) protein. In a further embodiment, the VLP further comprises Newcastle Disease Virus fusion (F) protein. In yet another embodiment, the VLP further comprises Newcastle Disease Virus fusion (F) protein and Newcastle Disease Virus heamagglutinin-neuraminidase (HN) protein In a further embodiment, such as where the invention's virus-like particles (VLPs) contain a type 3 protein, soluble protein, and/or epitope, the VLP comprises a transmembrane domain (TM) protein (such as from Newcastle Disease Virus fusion (F) protein), and a Newcastle Disease Virus fusion (F) protein cytoplasmic domain (CT) protein. In an alternative embodiment, the VLP comprises a transmembrane domain (TM) protein (such as from Newcastle Disease Virus heamagglutinin-neuraminidase (HN) protein), and a Newcastle Disease Virus heamagglutinin-neuraminidase (HN) protein cytoplasmic domain (CT) protein.

The invention also provides a vaccine comprising any of the virus-like particles (VLPs) disclosed herein.

Also provided by the invention is a method for producing a protein, comprising: a) providing a first expression vector comprising, in operable combination: 1) a first nucleic acid sequence encoding a transmembrane domain (TM) protein, 2) a second nucleic acid sequence encoding Newcastle Disease Virus cytoplasmic domain (CT) protein, and 3) a third nucleic acid sequence encoding a protein of interest, wherein the first nucleic acid sequence is flanked by the second and third nucleic acid sequences, b) providing a second expression vector comprising a fourth nucleic acid sequence encoding Newcastle Disease Virus matrix (M) protein, wherein the first and second expression vectors are the same or different, c) providing a host cell capable of being transfected by the vector, and d) transfecting the host cell with the first and second vectors to produce virus-like particles (VLPs) comprising the protein of interest. In one embodiment, the method further comprises step e) purifying the virus-like particles (VLPs). In another embodiment, the protein of interest is expressed on the outside surface of the virus-like particle (VLP). In one embodiment, the virus-like particle (VLP) is immunogenic.

While not intending to limit the invention's methods to any particular range of efficiency, in one embodiment, the efficiency of producing the invention's virus-like particles (VLPs) is at least 10 fold greater, at least 20 fold greater, and/or at least 30 fold greater than the efficiency of producing influenza virus-like particles (VLPs).

The invention also provides a method for immunizing an animal host, comprising: a) providing: 1) a vaccine comprising any of the virus-like particles (VLPs) disclosed herein, and 2) an animal host, and b) administering the vaccine to the animal host to produce an immune response. In one embodiment, the animal host is selected from the group of mammal, avian, amphibian, reptile, and insect. In one embodiment, the immune response comprises an antibody that specifically binds to the protein of interest. In another embodiment, the immune response comprises T lymphocytes that specifically bind to the protein of interest.

The invention also provides antibodies produced by the invention's methods.

DEFINITIONS

The terms used within the present invention are generally used according to those definitions accepted by one having ordinary skill in the art, with the following exceptions:

The term "virus-like particle" as used herein, refers to a non-infective viral subunit either with, or without, viral proteins. For example, a virus-like particle may completely lack the DNA or RNA genome. Further, a virus-like particle comprising viral capsid proteins may undergo spontaneous self-assembly. Preparations of virus-like particles are contemplated in one embodiment, where the preparation is purified free of infectious virions (or at least substantially free, such that the preparation has insufficient numbers to be infectious). Thus, the term "virus-like particle" and "VLP" includes a non-replicating viral shell that resembles live virus in external conformation. Methods for producing and characterizing recombinantly produced VLPs have been described for VLPs from several viruses, including human papilloma virus type 1 (Hagnesee et al. (1991) J. Virol. 67:315), human papilloma virus type 16 (Kirnbauer et al. Proc. Natl. Acad. Sci. (1992) 89:12180), HIV-1 (Haffer et al., (1990) J. Virol. 64:2653), and hepatitis A (Winokur (1991) 65:5029). Additional methods for expressing VLPs that contain Newcastle Disease virus proteins are provided by Pantua et al. (2006) J. Virol. 80:11062-11073, and disclosed herein.

The term "matrix protein", "membrane protein", or "M protein" as used herein, means any protein localized between the envelope and the nucleocapsid core and facilitates the organization and maintenance of the virion structure and budding processes.

The term "fusion protein" or "F protein" as used herein, means any protein that projects from the envelope surface and mediates host cell entry by inducing fusion between the viral envelope and the cell membrane. However, it is not intended that the present invention be limited to functional F proteins. For example, an F protein may be encoded by a mutant F gene such as, but not limited to, F-K115Q. F-K115Q is believed to eliminate the normal cleavage and subsequent activation of the fusion protein. F-K115Q mimics naturally occurring F-protein mutations in avirulent NDV strains, and in cell culture, eliminates any potential side effects of cell-cell fusion on the release of VLPs. Exemplary NDV F protein sequences include those comprising SEQ ID NO:10 (FIG. 10A) that is encoded by SEQ ID NO:11 (FIG. 10B), comprising SEQ ID NO:19 (FIG. 22A) (ATCC M21881), encoded by SEQ ID NO:20 (FIG. 22B), and SEQ ID NO:21 (FIG. 23) (ATCC AAG36978), and the following ATCC Accession numbers: AAA46642 (strain Texas GB), CAA00288 (strain Chambers), AB065262 (strain JL01), AAS00690 (strain F48E9), AAA46642 (strain Texas GB), CAF32456 (strain La Sota), AAC62244 (strain DB5), AAC62243 (strain DB3), AAC28467 (strain F48E9), ABY41269 (strain D58), ABV60351 (strain SNV-5074), AAL18935 (strain ZJ1), and AAY43057 (strain FM1/03).

The term "nucleocapsid protein" or "NP protein" as used herein, means any protein that associates with genomic RNA (i.e., for example, one molecule per hexamer) and protects the RNA from nuclease digestion. Exemplary NP protein sequences from NDV include those comprising SEQ ID NO:6 (FIG. 8A) encoded by SEQ ID NO:7 (FIG. 8B) (ATCC No. AB124608), SEQ ID NO:22 (FIG. 24A) encoded by SEQ ID NO:23 (FIG. 24B) (ATCC No. AF060483), and the following ATCC Accession Nos. P09459 (strain Beaudette C), Q99FY3 (strain AF2240), NP_071466 (strain B1), ABG35929 (strain chicken/China/Guangxi1/2000), AA276405 (strain PNY-LMV42), CAB51322 (strain clone 30), AB032476 (strain F), AAW30676 (strain LaSota), AA04779 (strainV4), BAD16677 (strainAPMV1/Quail/Japan/Chiba/2001), and BAD16672 (strain APMV1/chicken/Japan/Niiga/89).

The term "haemagglutinin-neuraminidase protein", "HN protein", or G protein as used herein, means any protein that spans the viral envelope and projects from the surface as spikes to facilitate cell attachment and entry (i.e., for example, by binding to sialic acid on a cell surface). These proteins possess both haemagglutination and neuraminidase activity. Exemplary NDV HN protein sequences include those comprising SEQ ID NO:8 (FIG. 9A) encoded by SEQ ID NO:9 (FIG. 9B), and those encoded by the mRNA SEQ ID NO:15 (FIG. 20A) and by SEQ ID NO:16 (FIG. 20B), as well as SEQ ID NO:17 (FIG. 21A), and the following ATCC Accession Numbers: CAB69409 (strain Texas GB), CAA00289 (strain Chambers), ABW34443 (strain JS-1/06/wd), ABW89770 (strain B1), CAA77272 (strain LaSota type), CAF32450 (strain LaSota), ABI16058 (strain PB9601), ABG35963 (strain Chicken/China/Guangxi5/

2000), U371189 (strain clone 30), U371190 (strain vineland), U371191 (strain VGGA), and U371193 (strain B1(SEDRL)).

The term "glycoprotein" as used herein, refers to any protein conjugated to a nonprotein group that comprises a carbohydrate.

The term "paramyxovirus" as used herein, refers to any virus of the Paramyxoviridae family of the Mononegavirales order; that are negative-sense single-stranded RNA viruses responsible for a number of human and animal diseases (i.e., for example, Newcastle disease). Paramyxoviruses include, but are not limited to, for example, Sendai virus, Newcastle disease virus, Mumps virus, Measles virus, Respiratory syncytial (RS) virus, rinderpest virus, distemper virus, simian parainfluenza virus (SV5), type I, II, and III human parainfluenza viruses, etc. Sendai viruses may be wild-type strains, mutant strains, laboratory-passaged strains, artificially constructed strains, or so on. Incomplete viruses such as the DI particle (J. Virol., 1994, 68, 8413-8417), synthesized oligonucleotides, and so on, may also be utilized as material for producing the vaccine of the present invention.

The term "Late Domain" as used herein, refers to any region in a viral protein that is involved in the budding of virus particles from a cell's plasma membrane. Late Domains comprise highly conserved motifs known to mediate protein-protein interactions between cellular proteins. For example, at least three classes of motifs comprise PTAP (SEQ ID NO:4), PPXY (SEQ ID NO:5), or YXXL (SEQ ID NO:3)(i.e., for example, a YANL sequence).

The term "vector" as used herein, refers to any nucleotide sequence comprising exogenous operative genes capable of expression within a cell. For example, a vector may comprise a nucleic acid encoding a viral matrix protein and at least two glycoproteins that are expressed within a human, avian, or insect cell culture system. For example, a baculovirus vector may be used to transfect various *Lepidoptera* species.

The term "transfect" or "transfecting" as used herein, refers to any mechanism by which a vector may be incorporated into a host cell. A successful transfection results in the capability of the host cell to express any operative genes carried by the vector. Transfections may be stable or transient. One example of a transient transfection comprises vector expression within a cell, wherein the vector is not integrated within the host cell genome. Alternatively, a stable transfection comprises vector expression within a cell, wherein the vector is integrated within the host cell genome.

The term "host" as used herein, refers to any organism capable of becoming infected by a virus and immunized by a virus-like particle. A host may be an avian host (i.e., for example, a chicken) or a mammalian host (i.e., for example, human, mouse, dog, rat, cow, sheep, etc.).

The term "sequence tag" as used herein, refers to any atom or molecule that can be used to provide a detectable (preferably quantifiable) signal, and that can be attached to a nucleic acid or protein. "Sequence tags" may provide signals detectable by fluorescence, radioactivity, colorimetry, gravimetry, X-ray diffraction or absorption, magnetism, enzymatic activity, and the like. A "sequence tag" may be a charged moiety (positive or negative charge) or alternatively, may be charge neutral. "Sequence tags" can include or consist of a nucleic acid or protein sequence, so long as the sequence comprising the "sequence tag" is detectable.

The term "adjuvant" as used herein, refers to any compound which enhances or stimulates the immune response when administered with an antigen(s). Exemplary adjuvants include binders such as carboxymethylcellulose, ethyl cellulose, microcrystalline cellulose, or gelatin; excipients such as starch, lactose or dextrins, disintegrating agents such as alginic acid, sodium alginate, Primogel, corn starch and the like; lubricants such as magnesium stearate or Sterotex; glidants such as colloidal silicon dioxide; sweetening agents such as sucrose or saccharin, a flavoring agent such as peppermint, methyl salicylate or orange flavoring, and a coloring agent.

BRIEF DESCRIPTION OF THE FIGURES

The patent or application file contains at least one drawing executed in color. Copies of this patent or patent application publication with color drawing(s) will be provided by the Office upon request and payment of the necessary fee.

The following figures are presented only as an illustration of specific embodiments of the present invention and are not intended to be limiting.

FIG. 1 presents exemplary data showing co-expression of NP, F, HN, and M proteins resulted in VLP formation and release. Radioactively labeled proteins in both the transfected (Panel A) and infected (Panel B) extracts were immunoprecipitated with a cocktail of antibodies specific for all viral proteins and precipitated labeled proteins are shown on the left side of each panel. VLP particles in cell supernatants were purified as described in Example 4. After flotation into sucrose gradients, each gradient fraction was immunoprecipitated with antibody cocktail (right side of each panel). The density of each fraction (g/cc) is shown at the bottom. Panel A: avian cells, co-transfected with pCAGGS(-NP), (-M), (F-K115Q), and (-HN), were radioactively labeled with $^{35}$S-methionine and $^{35}$S-cysteine for 4 hours (P) and then chased in non-radioactive medium for 8 hours (C). Panel B: avian cells, infected with NDV, strain AV, with a Multiplicity Of Infection (MOI) of 5 pfu for 5 hours, were pulse-labeled for 30 minutes and chased in non-radioactive medium for 8 hours. Panel C shows the quantitation of efficiency of virion and VLP release as determined by the amount of M protein in the pulse and chase cell extracts. The results of 3 separate experiments were averaged and the standard deviation is shown.

FIG. 2 presents exemplary data showing that M protein is sufficient for VLP release. Avian cells were transfected with pCAGGS-NP, -M, -F-K115Q, and -HN individually. Panel A shows radioactively labeled proteins in the extracts at time of pulse (left) and chase (right). Particles in the supernatants of avian cells expressing NP, M, F, and HN individually, were concentrated and floated into sucrose gradients as described above in FIG. 1. Panel B shows the distribution in the gradients of radioactively labeled proteins derived from each supernatant. Panel C shows the quantification of the amounts of each protein in VLPs. The results of three separate experiments were averaged and the standard deviation is shown.

FIG. 3 presents exemplary data showing effects of NP, F, or HN protein co-expression with M protein on VLP release. Avian cells, transfected with all possible combinations of two NDV structural protein genes (i.e., pair wise combinations including, but not limited to, F+NP, F+M, F+HN, HN+NP, HN+M and NP+M, wherein F is F-K115Q). Labeling in a pulse-chase protocol is as described in FIG. 1. Particles present in the supernatants were concentrated and then floated into sucrose gradients as described in Example 4. Panel A shows labeled proteins in cell extracts at time of pulse (top) and chase (bottom). Panel B shows the proteins present in each gradient fraction after immunoprecipitation of each fraction with an antibody cocktail. Densities (g/cc) of the fractions are shown at the bottom. Gradients from transfections that did not contain M protein are not shown since there were no radioactively labeled proteins in those gradients. Panel C shows the quantification of each protein in VLPs released from transfected avian cells. Results are the average of three experiments and the standard deviation is shown.

FIG. 4 presents exemplary data showing effects of expressing all combinations of three viral proteins on VLP release. Avian cells, transfected with all possible combinations of three NDV structural protein genes, were labeled in a pulse-chase protocol and particles in the supernatant were concentrated and floated into a sucrose gradient as in FIG. 1. The proteins in the cell extracts were immunoprecipitated with the antibody cocktail. Panel A show labeled proteins in cell extracts at time of pulse (top) and chase (bottom). Panel B shows the proteins present in each gradient fraction after immunoprecipitation of each fraction with an antibody cocktail for some of the viral protein combinations. Densities (g/cc) of the fractions are shown at the bottom. Panel C shows quantification of the amounts of each protein in VLPs. Panel D shows the efficiency of VLP release based on the percent of pulse labeled M protein remaining in the chase extracts. Panel E show the relative amounts of M protein in the pulse extracts.

FIG. 5 presents exemplary data showing that dominant-negative mutants of CHMP3 and Vps4-E228Q, blocked release of M protein-containing particles. Panel A, left, shows pulse labeled extracts of human 293T cells that were simultaneously transfected with pCAGGS-M (1.0 µg) and either pDsRed2-N1 vector (0.1, 0.5 and 1.0 µg) or pDsRed2-N1-CHMP3-RFP (0.1, 0.5 and 1.0 µg). Panel A, right, shows the VLPs released from these cells after an 8 hour chase. Panel B, left, shows extracts of pulse labeled cells that were simultaneously transfected with pCAGGS-M and either pBJ5 vector or pBJ5-Vps4A-E228Q-Flag. Panel B, right, shows the VLPs released from these cells after an 8 hour chase. Transfected 293T cells in both A and B were labeled in a pulse-chase protocol as described in FIG. 1. Particles from supernatants were concentrated by centrifugation onto a sucrose pad as described in Example 4. Panels C and D show percent VLPs released from cells transfected with pCAGGS-M and pDsRed2-N1-CHMP3 or pBJ5-Vps4A-E228Q relative to those released from cells transfected with pCAGGS-M and vector only. Panels E and F show the quantitation of protein expression (pulse label) in the cell extracts. Identical results were obtained in two separate experiments.

FIG. 6 presents a schematic of one embodiment of the viral protein structure of a representative Paramyxovirus.

FIG. 7 presents a schematic of one embodiment of an infectious cycle caused by a representative Paramyxovirus.

FIG. 8 presents an amino acid sequence (SEQ ID NO:6) (Panel A) and a nucleotide sequence (SEQ ID NO:7) (Panel B) encoding a first Newcastle disease virus nucleocapsid protein (AB124608).

FIG. 9 presents an amino acid sequence (SEQ ID NO:8) (Panel A) and a nucleotide sequence (SEQ ID NO:9) (Panel B) encoding a first Newcastle disease virus hemagglutinin-neuraminidase protein (AY288990).

FIG. 10 presents a partial amino acid sequence (SEQ ID NO:10) (Panel A) and a partial nucleotide sequence (SEQ ID NO:11) (Panel B) encoding a first Newcastle disease virus fusion protein (Y18728).

FIG. 11 presents an amino acid sequence (SEQ ID NO:12) (Panel A) and a nucleotide sequence (SEQ ID NO:13) (Panel B) encoding a first Newcastle disease virus matrix protein (AY728363).

FIGS. 12A/B present of a nucleotide sequence (SEQ ID NO:14) for a baculovirus expression vector (DQ003705).

FIG. 13 presents two exemplary plasmids comprising a pCAGGS expression vector. Panel A: pCAGGS/MCS; Panel B: pJW4303 (U.S. Pat. No. 5,916,879, herein incorporated by reference). It should be noted that the pCAGGS expression vector comprises a hybrid cytomegalovirus (CMV) beta actin promoter sequence.

FIG. 14 presents exemplary autoradiograph data showing viral protein accumulation resulting from a pulse-chase experiment that compares virus release from avian and COS-7 cells. Panel A: F protein. Panel B: NP protein.

FIG. 15 presents exemplary data showing the quantification pulse-chase autoradiography shown in FIG. 14. Panel A: F protein. Panel B: NP protein. Diamonds: Avian cells. Squares: COS-7 cells.

FIG. 16 presents exemplary autoradiograph data from purification of VLPs in sucrose gradients released from avian cells (Panel A) and from COS-7 cells (Panel B). Lanes 1-9 provide banding patterns in sucrose densities of 1.12-1.26, respectively. HN=heamagglutinin-neuraminidase protein. $F_0$=fusion protein; NP=nucleocapsid protein; M=matrix protein.

FIG. 17 presents an exemplary autoradiograph showing residual viral proteins in cell extract lysates following a pulse-chase experiment. Panel A: Avian cells. Panel B; COS-7 cells.

FIG. 18 presents exemplary data demonstrating the improved efficiency of M protein VLP release from avian (Panel A) versus COS-7 primate cells (Panel B) when transfected only by an M protein cDNA. Radioactively labeled M protein (M arrow) is shown in each sucrose gradient density fraction (i.e., Lanes 1-9; 1.12-1.26) is shown.

FIG. 19 presents exemplary densitometry data comparing a quantification of VLP particle release from avian (Panel A) and COS-7 primate cells (Panel B) after transfection by either NP, M, F-K115Q, and HN protein cDNAs individually, or transfected using a combination of NP, M, F-K115Q, and HN protein cDNAs, in combination (ALL).

FIG. 20 presents an amino acid sequence (SEQ ID NO:15) (Panel A) and a nucleotide sequence (SEQ ID NO:16) (Panel B) encoding a second Newcastle disease virus hemagglutinin-neuraminidase mRNA (M22110).

FIG. 21 presents an amino acid sequence (SEQ ID NO:17) (Panel A) and a nucleotide sequence (SEQ ID NO:18) (Panel B) encoding a third Newcastle disease virus hemagglutinin-neuraminidase protein (U37193).

FIG. 22 presents an amino acid sequence (SEQ ID NO:19) (Panel A) and a nucleotide sequence (SEQ ID NO:20) (Panel B) encoding a second Newcastle disease virus fusion protein (M21881).

FIG. 23 presents an amino acid sequence (SEQ ID NO:21) for a third Newcastle disease virus B1 fusion protein (AAG36978).

FIG. 24 presents an amino acid sequence (SEQ ID NO:22) (Panel A) and a nucleotide sequence (SEQ ID NO:23) (Panel B) encoding a second Newcastle disease virus nucleocapsid protein. (AF060483).

FIG. 25 presents an amino acid sequence (SEQ ID NO:24) (Panel A) and a nucleotide sequence (SEQ ID NO:25) (Panel B) encoding a second Newcastle disease virus matrix protein (M16622).

FIG. 26 presents one embodiment of an amino acid sequence (SEQ ID NO:26) (Panel A) and a nucleotide sequence (SEQ ID NO:27) (Panel B) encoding a third Newcastle disease virus matrix protein (U25828).

FIGS. 27A-27E present a nucleotide sequence (SEQ ID NO:28) of a Newcastle disease virus B1 complete genome (AF309418).

Figure 1A:
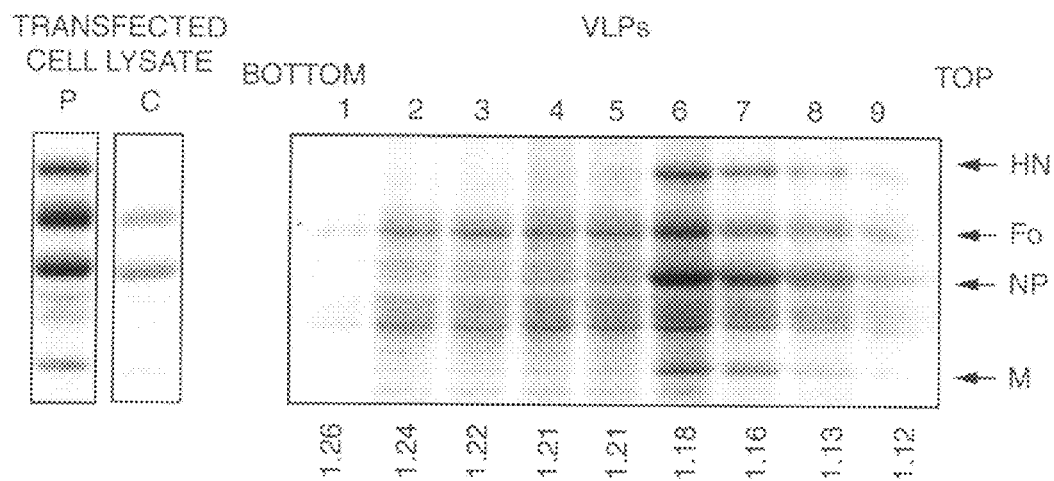

FIG. 32 presents one embodiment of an amino acid sequence (SEQ ID NO:29) (Panel A) and a nucleotide sequence (SEQ ID NO:30) (Panel B) encoding a first measles virus hemagglutinin protein (AY249267).

FIG. 33 presents one embodiment of an amino acid sequence (SEQ ID NO:31) (Panel A) and a nucleotide sequence (SEQ ID NO:32) (Panel B) encoding a second measles virus hemagglutinin protein (AY249269).

FIG. 34 presents one embodiment of an amino acid sequence (SEQ ID NO:33) (Panel A) and a nucleotide sequence (SEQ ID NO:34) (Panel B) encoding a third measles virus hemagglutinin protein (DQ011611).

FIG. 35 presents one embodiment of an amino acid sequence (SEQ ID NO:35) (Panel A) and a nucleotide sequence (SEQ ID NO:36) (Panel B) encoding a first measles virus fusion protein (AJ133108).

FIG. 36 presents one embodiment of an amino acid sequence (SEQ ID NO:37) (Panel A) and a nucleotide sequence (SEQ ID NO:38) (Panel B) encoding a second measles virus fusion protein (X05597).

FIG. 37 presents one embodiment of an amino acid sequence (SEQ ID NO:39) (Panel A) and a nucleotide sequence (SEQ ID NO:40) (Panel B) encoding a third measles virus fusion protein (Y17840).

FIG. 38 presents one embodiment of an amino acid sequence (SEQ ID NO:41) (Panel A) and a nucleotide sequence (SEQ ID NO:42) (Panel B) encoding a first measles virus nucleocapsid protein (M89921).

FIG. 39 presents one embodiment of an amino acid sequence (SEQ ID NO:43) (Panel A) and a nucleotide sequence (SEQ ID NO:44) (Panel B) encoding a second measles virus nucleocapsid protein (AF171232).

FIG. 40 presents one embodiment of an amino acid sequence (SEQ ID NO:45) (Panel A) and a nucleotide sequence (SEQ ID NO:46) (Panel B) encoding a third measles virus nucleocapsid protein (X01999).

FIG. 41 presents one embodiment of an amino acid sequence (SEQ ID NO:47) (Panel A) and a nucleotide sequence (SEQ ID NO:48) (Panel B) encoding a first measles virus matrix protein (D12682).

FIG. 42 presents one embodiment of an amino acid sequence (SEQ ID NO:49) (Panel A) and a nucleotide sequence (SEQ ID NO:50) (Panel B) encoding a second measles virus matrix protein (D12683).

FIG. 43 presents one embodiment of an amino acid sequence (SEQ ID NO:51) (Panel A) and a nucleotide sequence (SEQ ID NO:52) (Panel B) encoding a third measles virus matrix protein (AY124779).

FIG. 44 presents one embodiment of an amino acid sequence (SEQ ID NO:53) (Panel A) and a nucleotide sequence (SEQ ID NO:54) (Panel B) encoding a first respiratory syncytial virus G protein (i.e., for example, a glycoprotein G protein)(U92104).

FIG. 45 presents one embodiment of an amino acid sequence (SEQ ID NO:55) (Panel A) and a nucleotide sequence (SEQ ID NO:56) (Panel B) encoding a second respiratory syncytial virus G protein (AY333361).

FIG. 46 presents one embodiment of an amino acid sequence (SEQ ID NO:57) (Panel A) and a nucleotide sequence (SEQ ID NO:58) (Panel B) encoding a third respiratory syncytial virus G protein (AB117522).

FIG. 47 presents one embodiment of an amino acid sequence (SEQ ID NO:59) (Panel A) and a nucleotide sequence (SEQ ID NO:60) (Panel B) encoding a first respiratory syncytial virus fusion protein (AY198177).

FIG. 48 presents one embodiment of an amino acid sequence (SEQ ID NO:61) (Panel A) and a nucleotide sequence (SEQ ID NO:62) (Panel B) encoding a second respiratory syncytial virus fusion protein (Z26524).

FIG. 49 presents one embodiment of an amino acid sequence (SEQ ID NO:63) (Panel A) and a nucleotide sequence (SEQ ID NO:64) (Panel B) encoding a third respiratory syncytial virus fusion protein (D00850).

FIG. 50 presents one embodiment of an amino acid sequence (SEQ ID NO:65) (Panel A) and a nucleotide sequence (SEQ ID NO:66) (Panel B) encoding a first respiratory syncytial virus matrix protein (U02470).

FIG. 51 presents one embodiment of an amino acid sequence (SEQ ID NO:67) (Panel A) and a nucleotide sequence (SEQ ID NO:68) (Panel B) encoding a second respiratory syncytial virus matrix protein (U02510).

FIG. 52 presents one embodiment of an amino acid sequence (SEQ ID NO:69) (Panel A) and a nucleotide sequence (SEQ ID NO:70) (Panel B) encoding a first respiratory syncytial virus nucleocapsid protein (U07233).

FIG. 53 presents one embodiment of an amino acid sequence (SEQ ID NO:71) (Panel A) and a nucleotide sequence (SEQ ID NO:72) (Panel B) encoding a second respiratory syncytial virus nucleocapsid protein (X00001).

FIG. 54 presents one embodiment of an amino acid sequence (SEQ ID NO:73) (Panel A) and a nucleotide sequence (SEQ ID NO:74) (Panel B) encoding a third respiratory syncytial virus nucleocapsid protein (S40504).

FIG. 55 presents one embodiment of an amino acid sequence (SEQ ID NO:75) (Panel A) and a nucleotide sequence (SEQ ID NO:76) (Panel B) encoding a first parainfluenza virus 3 nucleocapsid protein (D10025).

FIG. 56 presents one embodiment of an amino acid sequence (SEQ ID NO:77) (Panel A) and a nucleotide sequence (SEQ ID NO:78) (Panel B) encoding a first parainfluenza virus 3 fusion protein (D00016).

FIG. 57 presents one embodiment of an amino acid sequence (SEQ ID NO:79) (Panel A) and a nucleotide sequence (SEQ ID NO:80) (Panel B) encoding a second parainfluenza virus 3 fusion protein (AF394241).

FIG. 58 presents one embodiment of an amino acid sequence (SEQ ID NO:81) (Panel A) and a nucleotide sequence (SEQ ID NO:82) (Panel B) encoding a first parainfluenza virus 3 matrix protein (D00130).

FIG. 59 presents one embodiment of an amino acid sequence (SEQ ID NO:83) (Panel A) and a nucleotide sequence (SEQ ID NO:84) (Panel B) encoding a first parainfluenza virus 3 hemagglutinin-neuraminidase protein (AB 189960).

FIG. 60 presents one embodiment of an amino acid sequence (SEQ ID NO:85) (Panel A) and a nucleotide sequence (SEQ ID NO:86) (Panel B) encoding a second parainfluenza virus 3 hemagglutinin-neuraminidase protein (AB189961).

FIG. 61 presents one embodiment of an amino acid sequence (SEQ ID NO:87) (Panel A) and a nucleotide sequence (SEQ ID NO:88) (Panel B) encoding a third parainfluenza virus 3 hemagglutinin-neuraminidase protein (L25350).

Figure 62:
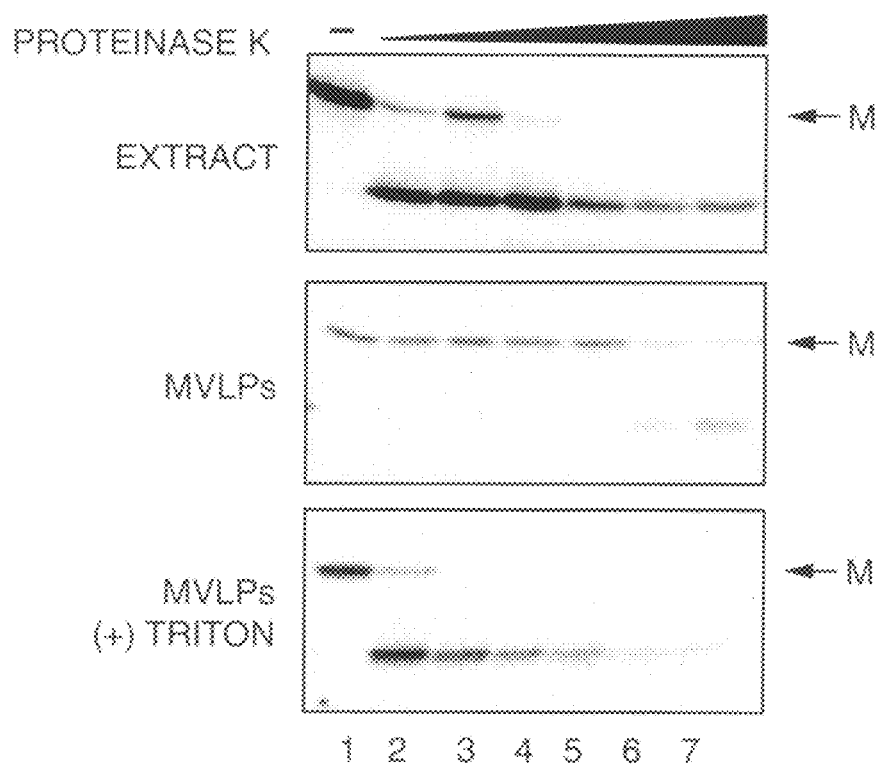

FIG. 62 presents exemplary data showing that M proteins may be encased in membranous particles. Avian cells were transfected with pCAGGS-M and radioactively labeled VLPs were isolated and purified. Extract (upper panel) and VLPs (middle panel) were treated with different concentrations (0.25, 0.5, 1, 5, 10, and 20 µg/ml; lanes 2 to 7 respectively) of Proteinase K for 30 minutes on ice. In parallel, VLPs were incubated in 1% Triton X-100 prior to Proteinase K treatment (bottom panel). After incubation with protease, reactions were stopped by adding 0.1 mM PMSF. M proteins were then immunoprecipitated.

Figure 63:
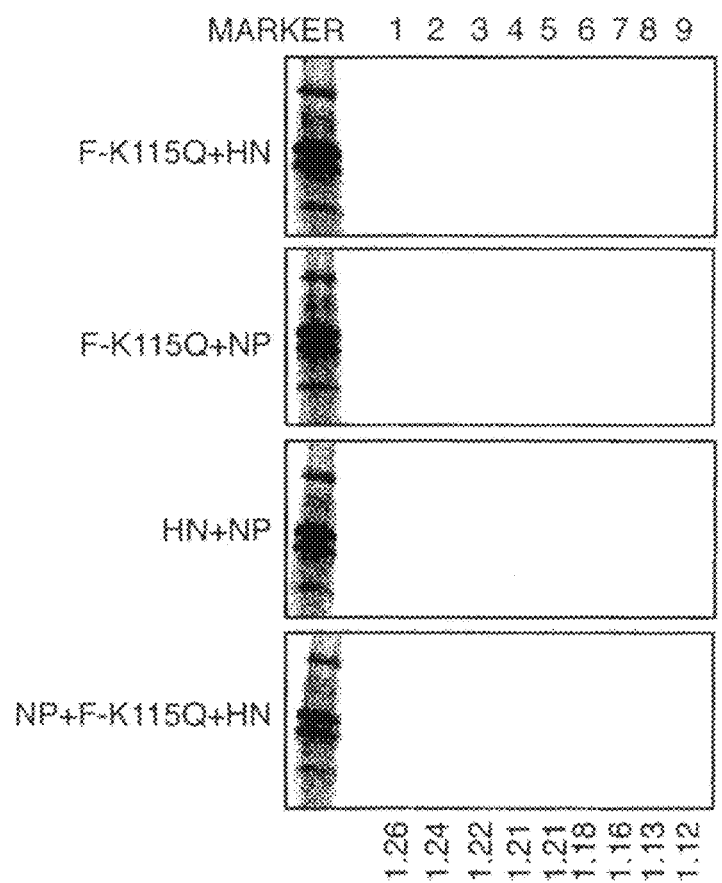

FIG. 63 presents exemplary data showing that M protein is required for VLP release. Avian cells were transfected with all possible combinations of cDNAs in pCAGGS vector encoding NP, F, and HN proteins in the absence of M cDNA (F-K115Q+HN, F-K115Q+NP, HN+NP, NP+F-K115Q+HN). Particles in cell supernatants were then purified. Panels show proteins present in each gradient fraction. Radioactively labeled infected cell extract was used as marker. Densities of fractions are shown at the bottom (g/cc).

FIG. 64 presents exemplary data showing co-localization of M protein with F and HN proteins. The cell surface localization of NDV F and HN proteins and the cellular localization of M proteins were analyzed by immunofluorescence microscopy. Avian cells were either transfected individually (A) or with F-K115Q+M or HN+M (B), with NP+M+F-K115Q, NP+M+HN or M+F-K115Q+HN(C) and all 4 cDNAs (D). Nuclei were stained with DAPI (blue) 40 h post-transfection. Intact transfected cells were stained with rabbit anti-F protein antibodies or anti-HN protein antibodies as indicated in the panels. Cells were permeabilized with 0.05% Triton X-100 prior to incubation with anti-M protein antibody. Secondary antibodies were anti-rabbit Alexa 488 conjugate (green) and anti-mouse Alexa 568 conjugate (red). Images were merged using Adobe Photoshop.

FIG. 65 presents exemplary data showing co-immunoprecipitation of viral proteins in VLPs. Radioactively labeled VLPs generated from cells expressing NP+M+F-K115Q+HN (A), M+F-K115Q+HN (B), NP+M+F-K115Q (C) and NP+M+HN (D) were lysed in TNE buffer with 1% Triton X-100. Lysed VLPs were then incubated with excess amounts of cocktail of anti-F protein antibodies (anti-HR1, anti-HR2, anti-Ftail, anti-F2-96 and monoclonal anti-F (G5)), anti-HN protein antibodies (mix of monoclonal antibodies), anti-M protein monoclonal antibody or cocktail of NDV-specific antibodies for overnight at 4° C. No antibody as well as pre-immune sera were used as negative controls. Immune complexes were precipitated with prewashed Pansorbin A for at least 2 h at 4° C. with constant mixing. Samples were washed three times in cold TNE with 0.5% Triton X-100. All steps of co-immunoprecipitation were accomplished at 4° C. Proteins were resolved by SDS-PAGE gel electrophoresis. Results show one of three independent experiments, all with identical results.

FIG. 66 presents exemplary data showing protein-protein interactions in VLPs. Inset: Various embodiments of viral protein-protein interactions detected by co-immunoprecipitation of proteins in VLPs. Also shown are illustrative potential interactions that may result in assembly of VLPs formed by co-expression of all combinations of NP, F, and HN proteins with M protein.

FIG. 67 presents exemplary data showing VLPs released from 293T cells. 293T cells transfected with pCAGGS M (Panel A) or with mixture of pCAGGS-NP, -M, -F-K155Q, and -HN (Panel B), were radioactively labeled with [$^{35}$S] methionine and [$^{35}$S] cysteine for 4 hours (P) and then chased in non-radioactive medium for 8 hours (C). Proteins present in cell lysates were immunoprecipitated with a cocktail of antibodies specific for all viral proteins and the precipitated labeled proteins are shown on the left side of each panel. Particles in cell supernatants were then purified. After flotation into sucrose gradients (right side of each panel), each gradient fraction was immunoprecipitated with the antibody cocktail. The density of each fraction (g/cc) is shown at the bottom.

FIG. 68 presents exemplary data showing the effect of wild type and dominant-negative mutant protein of the VPS pathway M protein VLP release. Panel A shows cell extracts of 293T cells (top) and corresponding released particles (bottom) from cells co-transfected with pCAGGS-M and either pDsRed2-N1 vector (lane 1), pBJ5-WT-CHMP3 (lane 2) or pDsRed2-N1-CHMP3-RFP (lane 3). Panel C shows cell extracts of 293T cells (top) and corresponding released particles (bottom) from cells co-transfected with pCAGGS-M and either pBJ5 vector (lane 1), pBJ5-WT-Vps4A (lane 2) or pBJ5-Vps4A-E228Q (lane 3). Panel E shows extracts of 293T cells (top) and corresponding VLPs (bottom) from cells co-transfected with pCAGGS-M and either pDsRed2-N1 vector (lane 1), pBJ5-AIP1-HA (lane 2) or pDsRed2-N-1-AIP1-HA-CHMP3-RFP (lane 3). Extracts are from pulse labeled cells. VLPs are released from pulse labeled cells during an 8-hour nonradioactive chase. Particles were then purified. Proteins were immunoprecipitated using NDV protein-specific antibodies and resolved by SDS-PAGE. Panels B, D and F show quantification of particles released relative to those released from wild type VPS protein controls. Identical results were obtained in two separate experiments.

FIG. 69 presents exemplary data showing the effect of dominant negative mutants of CHMP3, Vps4A and AIP1 on the release of complete VLPs. Panel A shows extracts of 293T cells (lanes 1-3) and corresponding released VLPs (lanes 4-6) from cells co-transfected with NDV cDNAs, encoding NP, M, HN, and F proteins, and either pDsRed2-N1 vector (lanes 1 and 4), pBJ5-WT-CHMP3 (lanes 2 and 5) or pDsRed2-N-1-CHMP3-RFP (lanes 3 and 6). Panel C shows extracts of 293T cells (lanes 1-3) and corresponding released VLPS (lanes 4-6) from cells co-transfected with the mixture of four NDV cDNAs and either pBJ5 vector (lanes 1 and 4), pBJ5-WT-Vps4A (lanes 2 and 5) or pBJ5-Vps4A-E228Q (lanes 3 and 6). Panel E shows extracts of 293T cells (lanes 1-3) and corresponding VLPs (lanes 4-6) from cells co-transfected with the mixture of NDV cDNAs and either pDsRed2-N1 vector (lanes 1 and 4), pBJ5-AIP 1-HA (lanes 2 and 5) or pDsRed2-N-1-AIP1-HA-RFP (lanes 3 and 6). Extracts are from pulse labeled cells. VLPs are released from pulse labeled cells during an 8-hour nonradioactive chase. Particles were then purified. Proteins were immunoprecipitated using NDV protein-specific antibodies and resolved by SDS-PAGE. Panels B, D, and F show quantification of VLPs released relative to vector and to wild type Vps protein controls. Identical results were obtained in two separate experiments.

FIG. 70 (SEQ ID NOS:293-302) presents exemplary data demonstrating the functionality of the L domain in NDV M protein. Panel A shows wild type M protein, mutant M proteins with alanine substitutions at amino acid positions 216 and 219 (M-$A_{216}A_{219}$) or 232 and 235 (M-$A_{232}A_{235}$), and YPDL or PTAP substitutions at positions 232-235. Panel B shows extract (top) and VLPs released (bottom) from 293T cells expressing wild type or mutant M proteins. Panel D shows extract (left) and VLPs released (right) from 293T cells expressing NP, F and HN proteins with either wild type or mutant M proteins. Particles were then purified. Proteins were immunoprecipitated using NDV protein-specific antibodies and resolved by SDS-PAGE. Panels C and E shows quantification of VLPs released relative to wild type M protein. Identical results were obtained in two separate experiments.

Figure 71A:
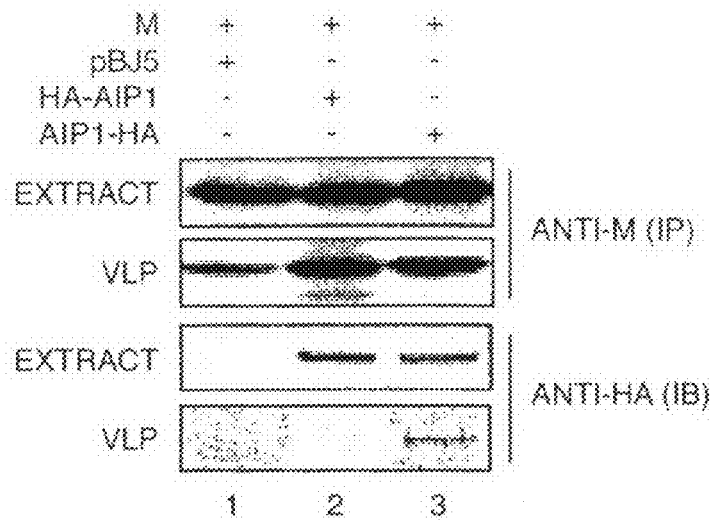
Figure 71B:
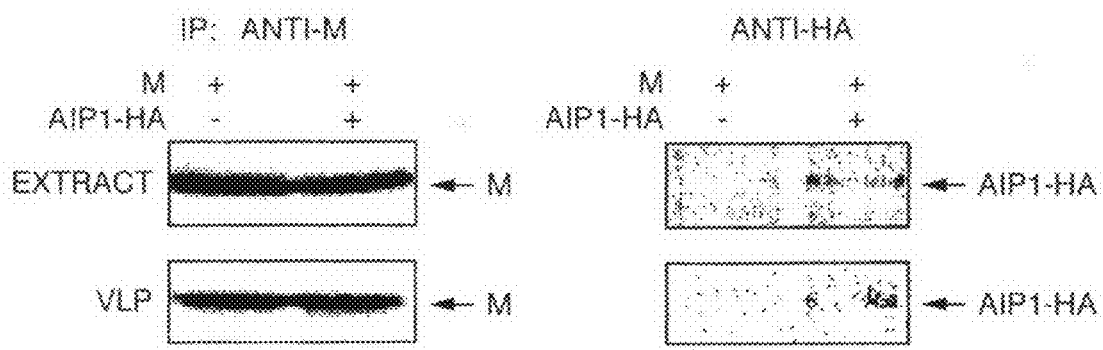

FIG. 71 presents exemplary data showing the incorporation of AIP1 in VLPs. 293T cells were transfected with pCAGGS M and either empty vector, or vector with HA-tagged AIP1. Panel A shows radioactively labeled M protein precipitated from cell extracts (anti-M IP) and VLPs using M protein-specific monoclonal antibody. HA-AIP1 (N-terminally tagged) and AIP1-HA (C-terminally tagged) were detected in extracts and VLPs by immunoblotting using HA antibody conjugated with peroxidase (anti-HA-IB). Panel B shows precipitated radiolabeled M protein and AIP1-HA from cell extracts (top) and VLPs (bottom).

Figure 72:
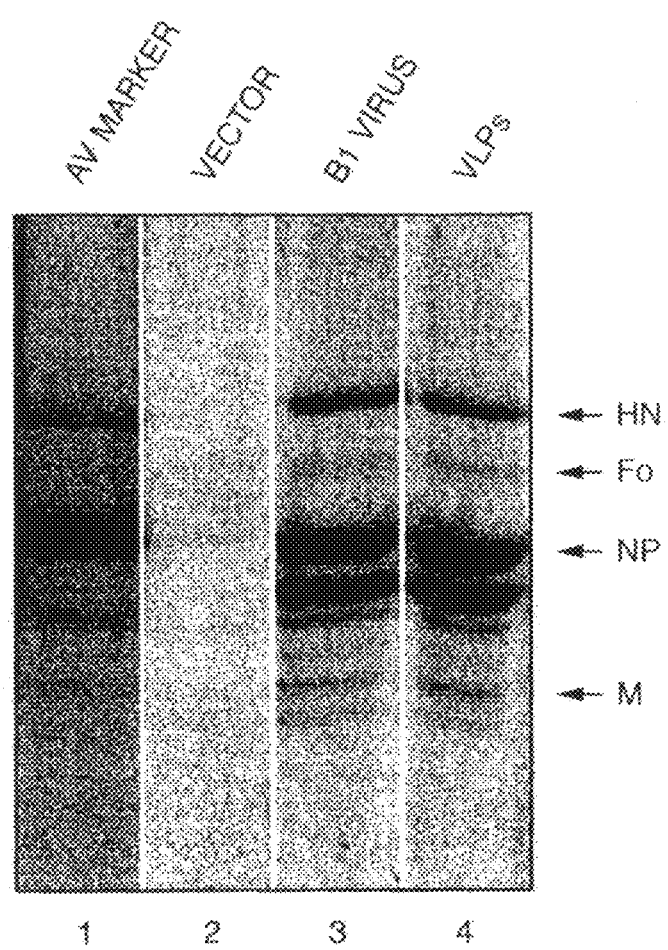

FIG. 72 presents exemplary data comparing the protein content of purified NDV virus and VLPs without prior immunoprecipitation.

Figure 73:
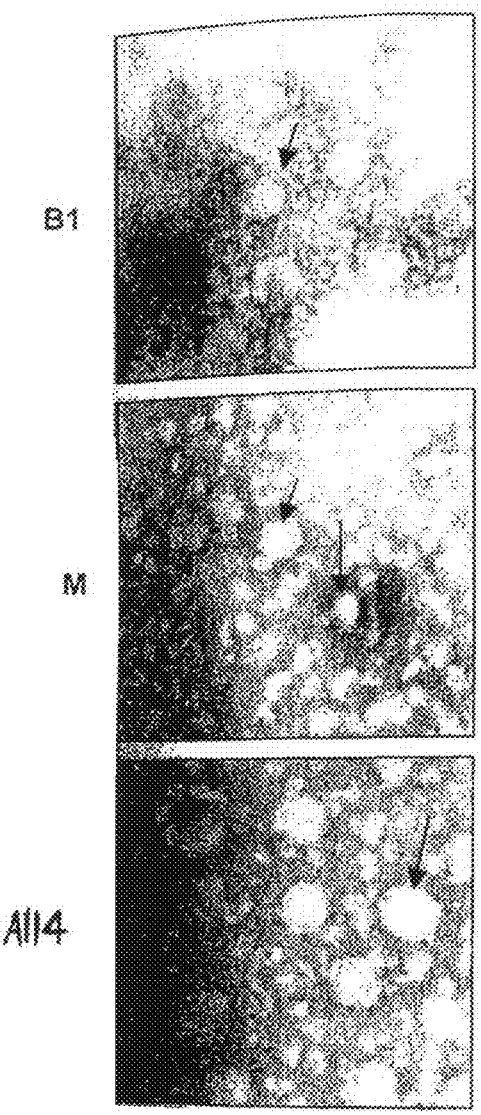

FIG. 73 presents exemplary electron micrographs showing virus (B1) (upper panel), M protein-only VLPs (middle panel) and NP, M, F, and HN VLPs (lower panel).

Figure 74:
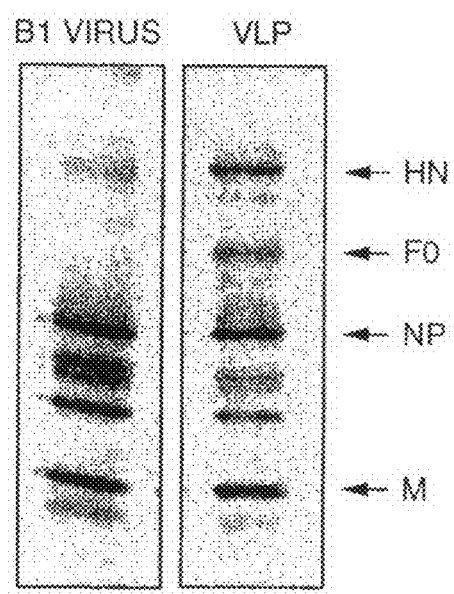

FIG. 74 presents exemplary data showing a silver stain of virus (B1) when grown in eggs as compared to VLPs prepared from a large scale tissue culture.

FIG. 75 shows the amino acid sequence (SEQ ID NO: 186) for Canine Distemper Virus Fusion protein.

FIG. 76 shows the amino acid sequence (SEQ ID NO: 187) for Cytomegalovirus (CMV) gG glycoprotein.

FIG. 77 shows the amino acid sequence (SEQ ID NO: 188) for Cytomegalovirus gH Glycoprotein.

FIG. 78 shows the nucleotide sequence (SEQ ID NO: 209) encoding Cytomegalovirus gH Glycoprotein.

FIG. 79 shows the amino acid sequence (SEQ ID NO: 189) for Ebola virus Glycoprotein precursor.

FIG. 80 shows the nucleotide sequence (SEQ ID NO: 210) encoding Ebola virus Glycoprotein precursor.

FIG. 81 shows the amino acid sequence (SEQ ID NO: 190) for Human Immunodeficiency Virus (HIV) envelope protein.

FIG. 82 shows the nucleotide sequence (SEQ ID NO: 211) encoding Human Immunodeficiency Virus (HIV) envelope protein.

FIG. 83 shows the amino acid sequence (SEQ ID NO: 191) for Herpes Simplex virus (HSV) gH glycoprotein.

FIG. 84 shows the nucleotide sequence (SEQ ID NO: 212) encoding Herpes Simplex virus (HSV) gH glycoprotein.

FIG. 85 shows the amino acid sequence (SEQ ID NO: 192) for Herpes Simplex virus (HSV) gL Glycoprotein.

FIG. 86 shows the nucleotide sequence (SEQ ID NO: 213) encoding Herpes Simplex virus (HSV) gL Glycoprotein.

FIG. 87 shows the amino acid sequence (SEQ ID NO: 193) for Influenza virus HA-type Hi protein.

FIG. 88 shows the nucleotide sequence (SEQ ID NO: 214) for Influenza virus B HA protein.

FIG. 89 shows the amino acid sequence (SEQ ID NO: 194) for Influenza virus HA from influenza virus B HA Malaysia protein.

FIG. 90 shows the nucleotide sequence (SEQ ID NO: 215) encoding Influenza virus HA from influenza B Malaysia protein.

FIG. 91 shows the amino acid sequence (SEQ ID NO: 195) for Influenza virus HA second representative H1 protein.

FIG. 92 shows the nucleotide sequence (SEQ ID NO: 216) encoding Influenza virus HA second representative H1 protein.

FIG. 93 shows the amino acid sequence (SEQ ID NO: 196) for Influenza virus HA representative H3 protein.

FIG. 94 shows the nucleotide sequence (SEQ ID NO: 217) encoding Influenza virus HA representative H3 protein.

FIG. 95 shows the amino acid sequence (SEQ ID NO: 197) for Influenza virus HA representative H5 HA protein.

FIG. 96 shows the nucleotide sequence (SEQ ID NO: 218) encoding Influenza virus HA representative H5 HA protein.

FIG. 97 shows the amino acid sequence (SEQ ID NO: 198) for Influenza virus HA representative H7 HA protein.

FIG. 98 shows the nucleotide sequence (SEQ ID NO: 219) encoding Influenza virus HA representative H7 HA protein.

FIG. 99 shows the amino acid sequence (SEQ ID NO: 199) for Influenza virus HA representative H9 HA protein.

FIG. 100 shows the nucleotide sequence (SEQ ID NO: 220) encoding Influenza virus HA representative H9 HA protein.

FIG. 101 shows the amino acid sequence (SEQ ID NO: 200) for Nipah virus F protein.

FIG. 102 shows the nucleotide sequence (SEQ ID NO: 221) encoding Nipah virus F protein.

FIG. 103 shows the amino acid sequence (SEQ ID NO: 201) for Respiratory Syncytial Virus (RSV) F protein (first example).

FIG. 104 shows the nucleotide sequence (SEQ ID NO: 222) encoding Respiratory Syncytial Virus (RSV) F protein (first example).

FIG. 105 shows the amino acid sequence (SEQ ID NO: 202) for Respiratory Syncytial Virus F protein (second example).

FIG. 106 shows the amino acid sequence (SEQ ID NO: 203) for SARS virus surface spike glycoprotein.

FIG. 107 shows the nucleotide sequence (SEQ ID NO: 223) encoding SARS virus surface spike glycoprotein.

FIG. 108 shows the amino acid sequence (SEQ ID NO: 205) for Varicella Zoster Virus gB glycoprotein.

FIG. 109 shows the nucleotide sequence (SEQ ID NO: 224) encoding Varicella Zoster Virus gB glycoprotein.

FIG. 110 shows the amino acid sequence (SEQ ID NO: 206) for Varicella Zoster Virus gE glycoprotein.

FIG. 111 shows the nucleotide sequence (SEQ ID NO: 225) encoding Varicella Zoster Virus gE glycoprotein.

FIG. 112 shows the amino acid sequence (SEQ ID NO: 207) for Varicella Zoster Virus gI glycoprotein.

FIG. 113 shows the nucleotide sequence (SEQ ID NO: 226) encoding Varicella Zoster Virus gI glycoprotein.

FIG. 114 shows the amino acid sequence (SEQ ID NO: 115) for Canine Distemper Virus H Glycoprotein.

FIG. 115 shows the amino acid sequence (SEQ ID NO: 116) for Avian Metapneumovirus G protein.

FIG. 116 shows the nucleotide sequence (SEQ ID NO: 133) encoding Avian Metapneumovirus G protein.

FIG. 117 shows the amino acid sequence (SEQ ID NO: 117) for Human Metapneumovirus G Glycoprotein.

FIG. 118 shows the nucleotide sequence (SEQ ID NO: 134) encoding Human Metapneumovirus G Glycoprotein.

FIG. 119 shows the amino acid sequence (SEQ ID NO: 118) for Human Respiratory Syncytial Virus G Glycoprotein.

FIG. 120 shows the amino acid sequence (SEQ ID NO: 119) for Influenza Virus B NA Glycoprotein.

FIG. 121 shows the amino acid sequence (SEQ ID NO: 120) for Influenza Virus N1 NA from H5N1 Virus protein.

FIG. 122 shows the nucleotide sequence (SEQ ID NO: 135) encoding Influenza Virus N1 NA from H5N1 Virus protein.

FIG. 123 shows the amino acid sequence (SEQ ID NO: 121) for Influenza Virus NA N2 protein (first example).

FIG. 124 shows the amino acid sequence (SEQ ID NO: 122) for Influenza Virus NA N2 type protein (second example).

FIG. 125 shows the nucleotide sequence (SEQ ID NO: 136) encoding Influenza Virus NA N2 type protein (second example).

FIG. 126 shows the amino acid sequence (SEQ ID NO: 123) for Influenza Virus NA N3 type protein.

FIG. 127 shows the nucleotide sequence (SEQ ID NO: 137) encoding Influenza Virus NA N3 type protein.

FIG. 128 shows the amino acid sequence (SEQ ID NO: 124) for Measles Virus HA protein.

FIG. 129 shows the nucleotide sequence (SEQ ID NO: 138) encoding Measles Virus HA protein.

FIG. 130 shows the amino acid sequence (SEQ ID NO: 125) for Mumps Virus HN protein.

FIG. 131 shows the nucleotide sequence (SEQ ID NO: 139) encoding Mumps Virus HN protein.

FIG. 132 shows the amino acid sequence (SEQ ID NO: 126) for Nipah Virus G protein.

FIG. 133 shows the nucleotide sequence (SEQ ID NO: 140) encoding Nipah Virus G protein.

FIG. 134 shows the amino acid sequence (SEQ ID NO: 127) for Parainfluenza Virus Type 2 HN protein.

FIG. 135 shows the nucleotide sequence (SEQ ID NO: 141) encoding Parainfluenza Virus Type 2 HN protein.

FIG. 136 shows the amino acid sequence (SEQ ID NO: 128) for Parainfluenza Virus 3 HN Glycoprotein (first example)

FIG. 137 shows the amino acid sequence (SEQ ID NO: 129) for Parainfluenza 3 Virus HN protein (second example).

FIG. 138 shows the nucleotide sequence (SEQ ID NO: 142) encoding Parainfluenza 3 Virus HN protein (second example).

FIG. 139 shows the amino acid sequence (SEQ ID NO: 130) for Respiratory Syncytial Virus G protein.

FIG. 140 shows the nucleotide sequence (SEQ ID NO: 143) encoding Respiratory Syncytial Virus G protein.

FIG. 141 shows the amino acid sequence (SEQ ID NO: 131) for Vaccinia Virus Surface Antigen.

FIG. 142 shows the nucleotide sequence (SEQ ID NO: 144) encoding Vaccinia Virus Surface Antigen.

FIG. 143 shows the amino acid sequence (SEQ ID NO: 145) for Epstein Barr Virus (EBV) LMP2A protein.

FIG. 144 shows the nucleotide sequence of eight exons (SEQ ID Nos: 150-157) encoding Epstein Barr Virus (EBV) LMP2A protein.

FIG. 145 shows the amino acid sequence (SEQ ID NO: 146) for Glut 1 HTLV receptor protein.

FIG. 146 shows the nucleotide sequence (SEQ ID NO: 158) encoding Glut 1 HTLV receptor protein.

FIG. 147 shows the amino acid sequence (SEQ ID NO: 147) for Glutamate Receptor protein.

FIG. 148 shows the nucleotide sequence (SEQ ID NO: 159) encoding Glutamate Receptor protein.

FIG. 149 shows the amino acid sequence (SEQ ID NO: 148) for Hepatitis B virus L form of S glycoprotein.

FIG. 150 shows the nucleotide sequence (SEQ ID NO: 160) encoding Hepatitis B virus L form of S glycoprotein.

FIG. 151 shows the amino acid sequence (SEQ ID NO: 149) for Prion protein.

FIG. 152 shows the nucleotide sequence (SEQ ID NO: 161) encoding Prion protein.

FIG. 153 shows the amino acid sequence (SEQ ID NO: 162) for Hepatitis A Virus VP 1 protein.

FIG. 154 shows the nucleotide sequence (SEQ ID NO: 167) encoding Hepatitis A Virus VP1 protein.

FIG. 155 shows the amino acid sequence (SEQ ID NO: 163) for Human Parvovirus VP (B19 Virus) protein.

FIG. 156 shows the nucleotide sequence (SEQ ID NO: 168) encoding Human Parvovirus VP (B19 Virus) protein.

FIG. 157 shows the amino acid sequence (SEQ ID NO: 164) for Norovirus VP1 protein.

FIG. 158 shows the nucleotide sequence (SEQ ID NO: 169) encoding Norovirus VP1 protein.

FIG. 159 shows the amino acid sequence (SEQ ID NO: 165) for Human Rhinovirus VP1 protein.

FIG. 160 shows the nucleotide sequence (SEQ ID NO: 170) encoding Human Rhinovirus VP1 protein.

FIG. 161 shows the amino acid sequence (SEQ ID NO: 166) for Human Rotavirus (strain K8) VP4 protein.

FIG. 162 shows the nucleotide sequence (SEQ ID NO: 171) encoding Human Rotavirus (strain K8) VP4 protein.

Figure 163:
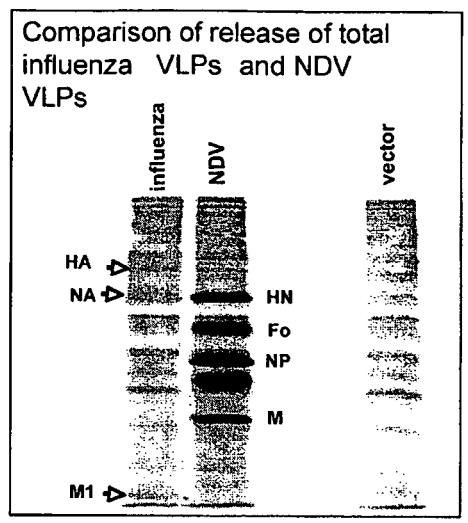

FIG. 163 shows generation of Influenza and ND VLPs. Avian cells were co-transfected with cDNAs encoding the influenza M1, HA, and NA proteins (influenza). In a separate plate, avian cells were co-transfected with cDNAs encoding the NDV M, NP, HN, and F proteins (NDV). Another plate received only empty vector DNA (vector). At 40 hours after transfection, cells were radioactively labeled and at 48 hours particles released into the cell supernatants were purified and concentrated by centrifugation through a 20% sucrose pad. The pelleted particles were resolved on a polyacrylamide gel and proteins in the particles detected by autoradiography.

Figure 164:
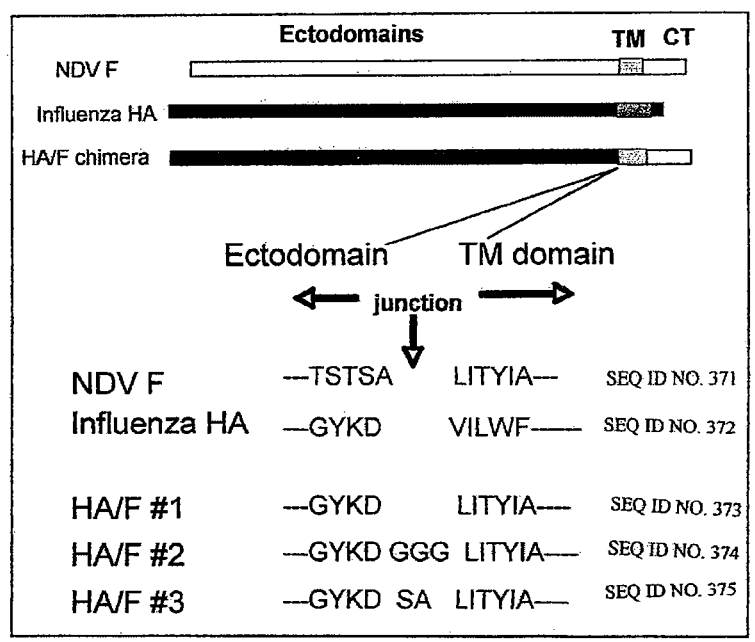

FIG. 164 (SEQ ID NOS:371-375) shows construction of chimera protein genes. Top shows a diagram of the NDV F and the Influenza HA and the domains of each used for the constructions. Bottom shows the sequences at the junction of the HA ectodomain and the F protein TM domain.

Figure 165:
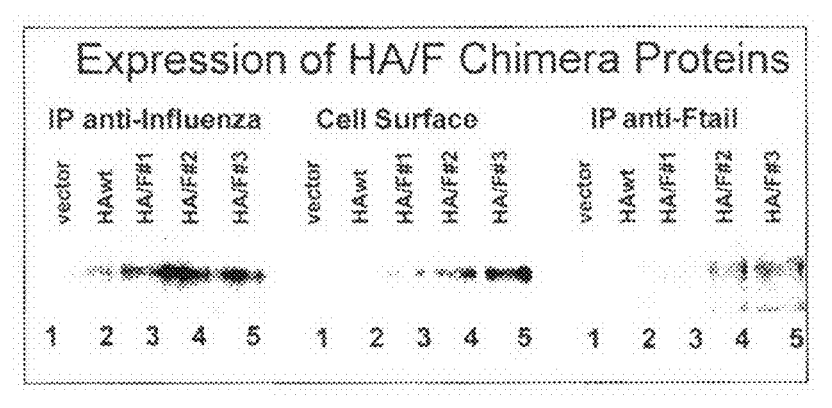

FIG. 165 shows expression of chimera HA/F proteins. Avian cells were transfected with cDNAs encoding the proteins indicated at the top of each panel. Left panel, radioactively labeled proteins were immunoprecipitated (IP) with antibody specific for influenza virus. Middle panel: Surfaces of cells were biotinylated to label surface expressed proteins as previously described (McGinnes et al. (2006) J. Virol. 80:2894-2903). Biotinylated proteins are shown. Right panel: proteins were immunoprecipitated with antibody specific for the CT domain of the NDV F protein.

Figure 166:
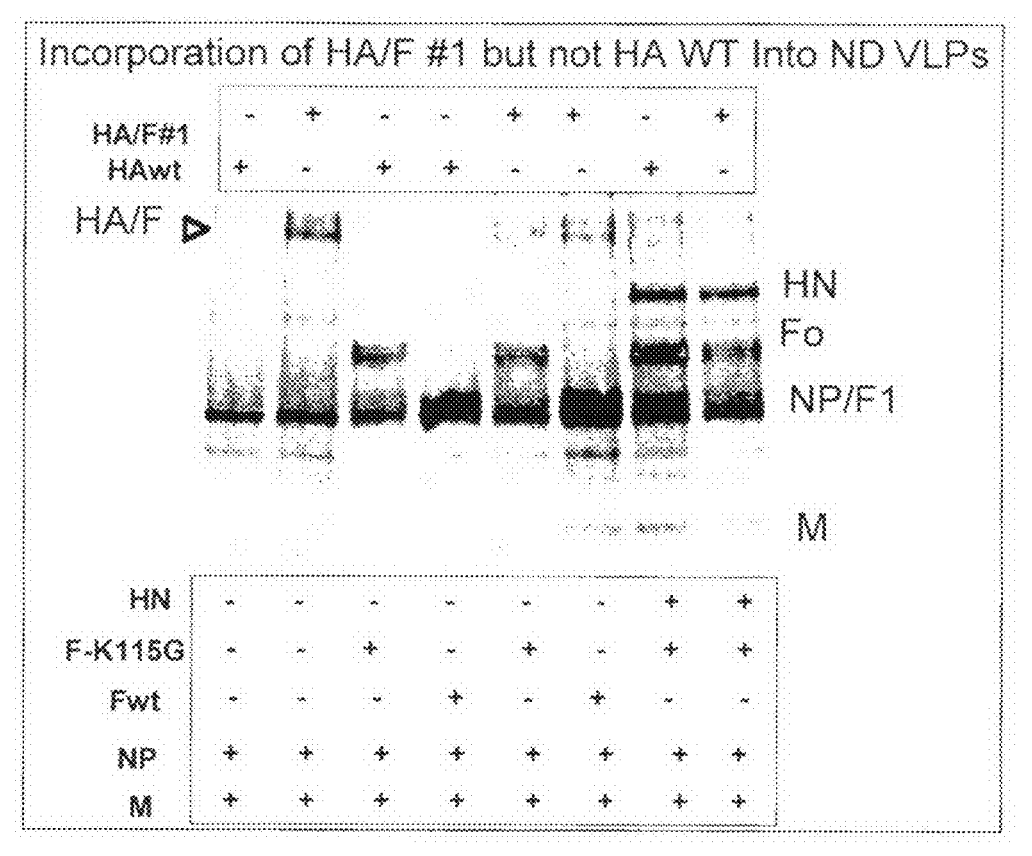

FIG. 166 shows incorporation of HA/F into ND VLPs. Avian cells were transfected with cDNAs indicated for each lane. At 40 hours after transfection, cells were radioactively labeled and at 48 hours particles in the cell supernatants were purified by centrifugation through a 20% sucrose pad. The proteins in the particles were resolved on polyacrylamide gels and detected by autoradiography.

Figure 167:
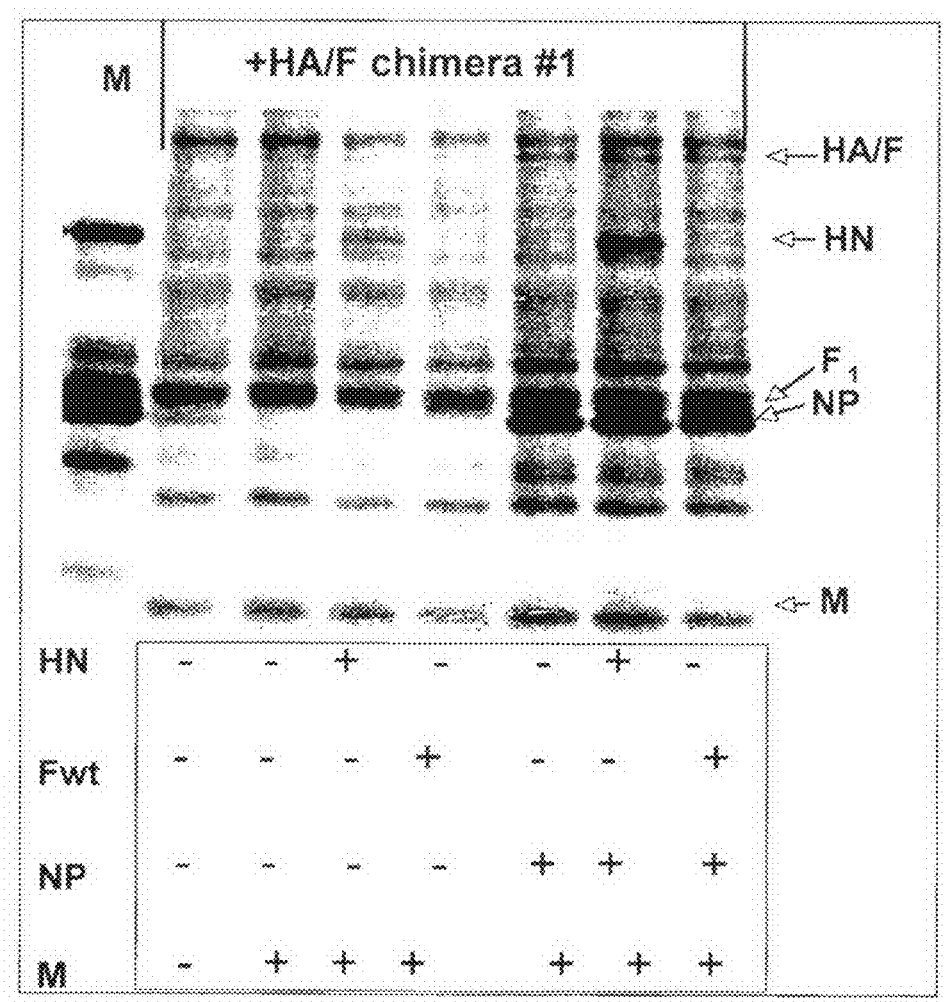

FIG. 167 shows incorporation of HA/F into ND VLPs. Avian cells were transfected with cDNAs indicated for each lane. At 40 hours after transfection cells were radioactively labeled and at 48 hours particles in the cell supernatants were purified by centrifugation through a 30% sucrose pad. The proteins in the particles were resolved on polyacrylamide gels and detected by autoradiography.

FIG. 168 (SEQ ID NOS:376-378) shows construction of chimera protein genes. Top shows a diagram of the NDV HN and the Influenza NA and the domains of each used for the constructions. Bottom shows the sequences at the junction of the NA ectodomain and the HN TM domain.

Figure 169:
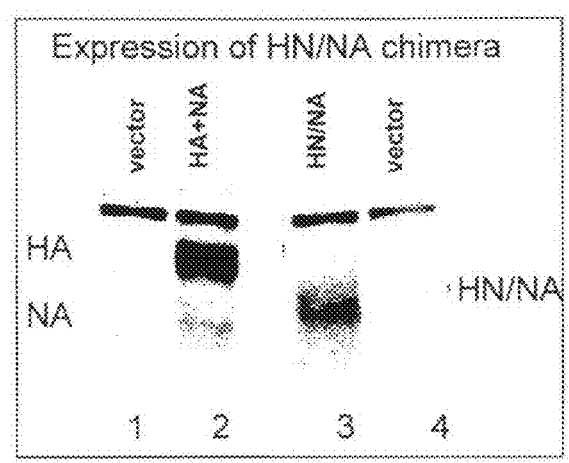

FIG. 169 shows expression of HN/NA chimera protein. Avian cells were transfected with vector (lanes 1 and 4) or with cDNAs encoding the influenza NA (and HA) (lane 2) or a cDNA encoding the HN/NA chimera (lane 3). Proteins in the resulting cell extracts were immunoprecipitated with anti-influenza antibody and the precipitated proteins resolved on polyacrylamide gels.

Figure 170:
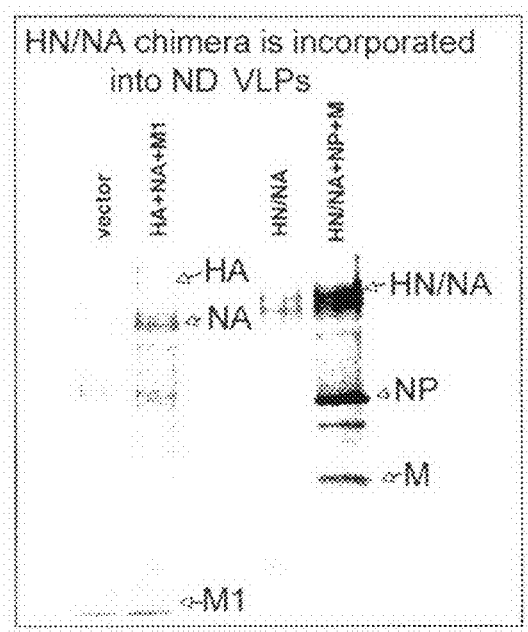

FIG. 170 shows incorporation of HN/NA chimera into VLPs. Avian cells were transfected with cDNAs indicated at the top of each lane. Cells were radioactively labeled from 40-48 hours post transfection and particles released from cells were purified by sedimentation through a 20% sucrose pad. Radioactive proteins associated with the particles were resolved on polyacrylamide gels and visualized by autoradiography.

Figure 171:
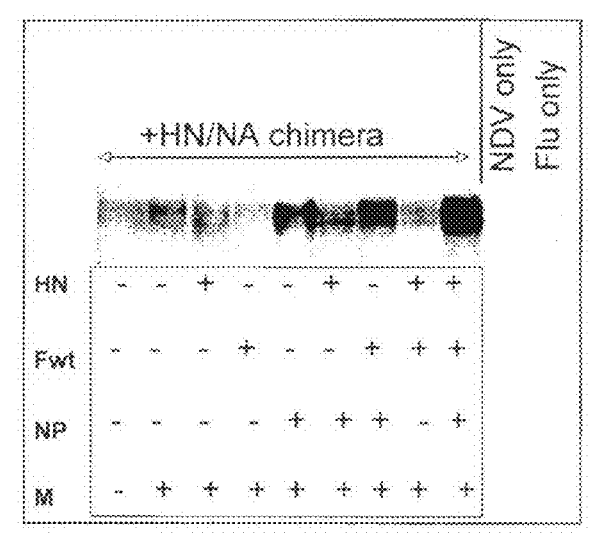

FIG. 171 shows influence of different NDV proteins on the incorporation of the HN/NA chimera into ND VLPs. The cDNA encoding the HN/NA chimera was co-transfected with cDNAs indicated at the bottom of each lane. Radioactively labeled particles were purified, lysed, and proteins immunoprecipitated with anti-influenza antisera. The HN/NA chimera protein in each precipitate was resolved on polyacrylamide gels and visualized by autoradiography.

Figure 172:
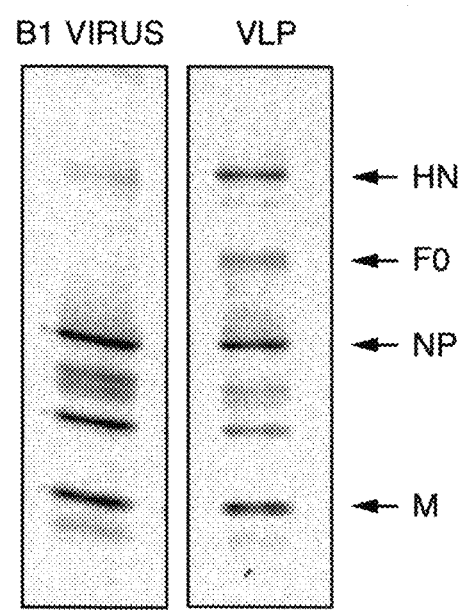

FIG. 172 shows silver stain of VLPs. Proteins in purified VLPs, separated on polyacrylamide gels, were visualized by silver staining. Egg-grown B1 virus is also shown.

Figure 173:
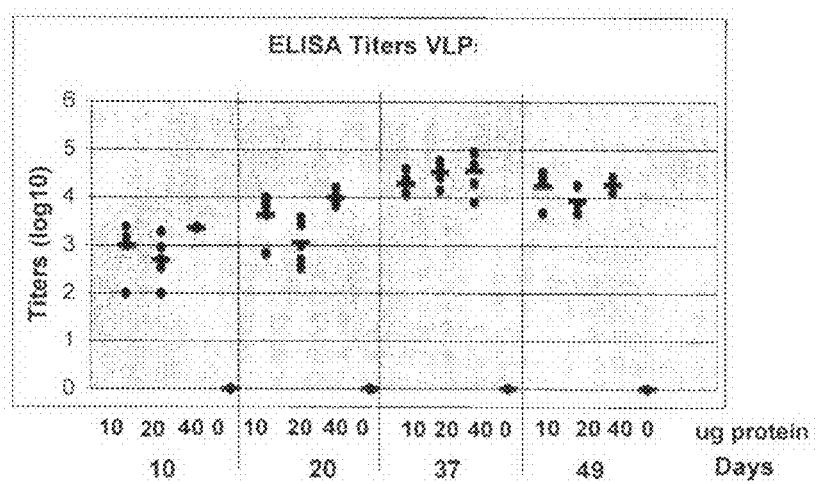

FIG. 173 shows ELISA titers of serum antibodies after immunization with VLP: Graph shows antibody titers (defined in FIG. 11) in serum collected at 10, 20, 37, and 49 days post immunization with VLPs. The initial immunization dose for each group of five mice is shown at the bottom (microgram of protein). A boost of 10 micrograms of VLP protein was given to each mouse at day 27. Horizontal line, average values for each group.

Figure 174:
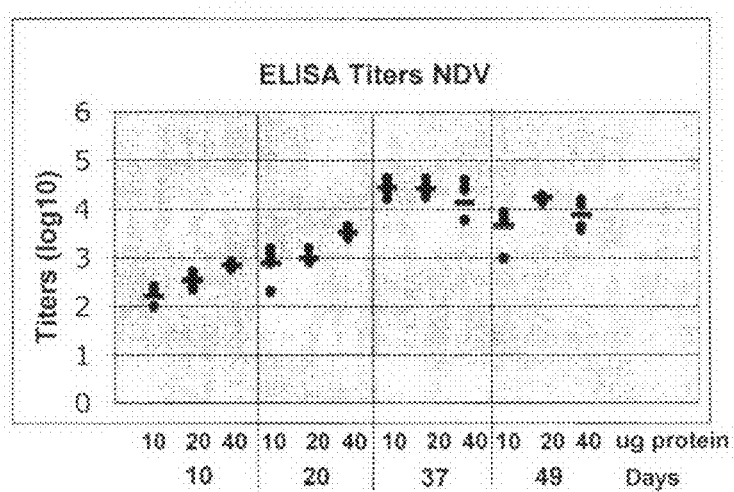

FIG. 174 shows ELISA titers of serum antibodies after immunization with virus: Graph shows antibody titers (defined in FIG. 173) in serum collected at 10, 20, 37, and 49 days post immunization with UV inactivated NDV. The initial immunization dose for each group of five mice is shown at the bottom (microgram of protein). A boost of 10 micrograms of virion protein was given to each mouse at day 27. Horizontal line shows average values for each group.

Figure 175A:
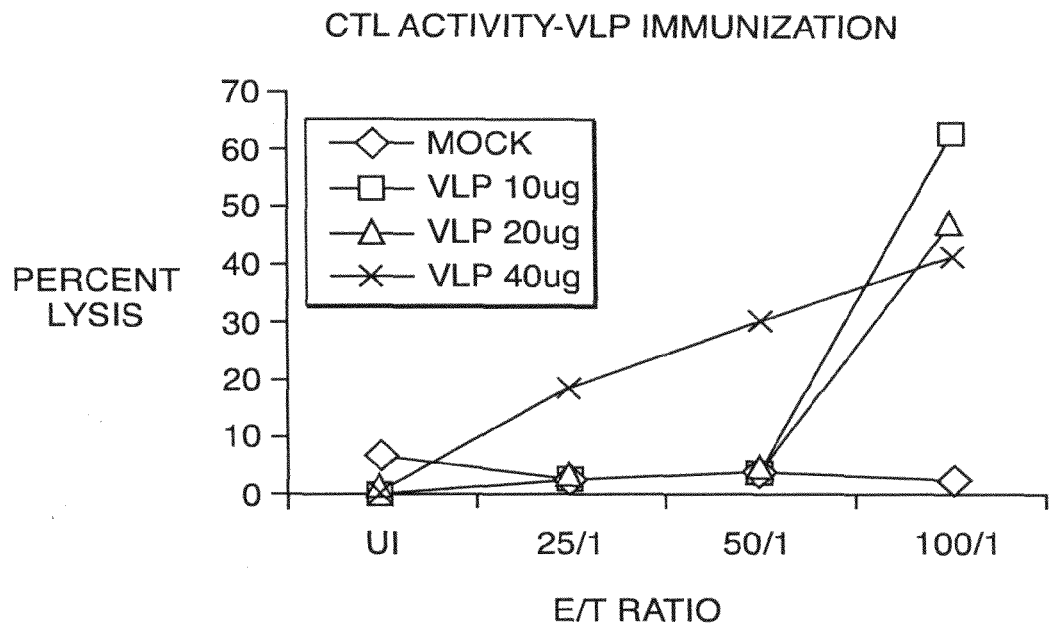
Figure 175B:
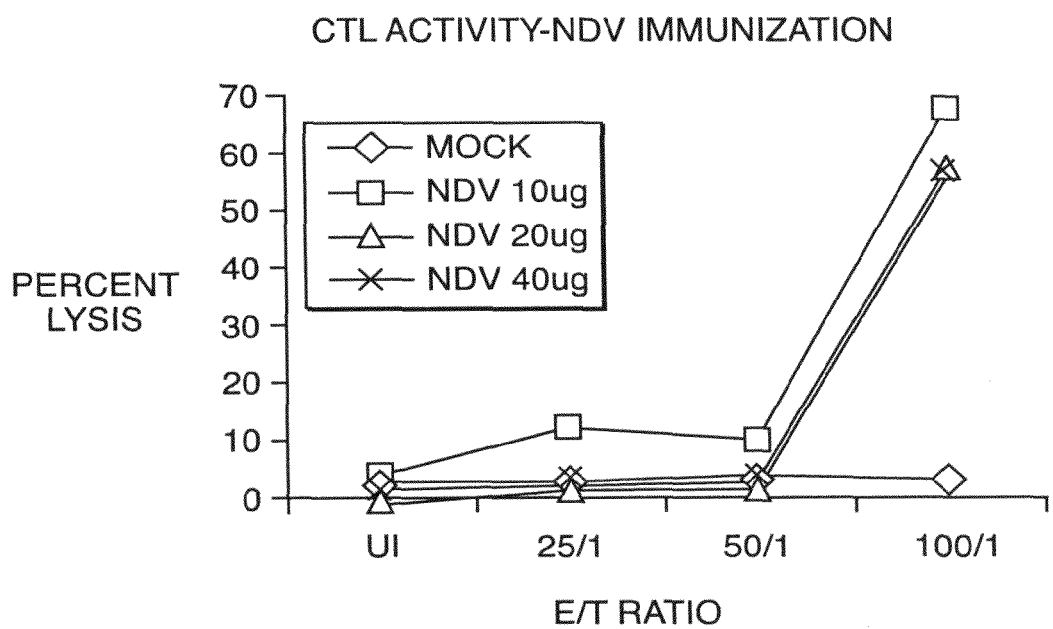

FIG. 175 shows CTL activity of spleen cells after immunization with different concentrations of VLPs and Virus. Effector-to-target ratios (E/T) are shown at the bottom and the percent specific lysis is shown on the y-axis. Results at each point are the average of the five mice in the group. The spontaneous chromium release was 10%.

Figure 176A:
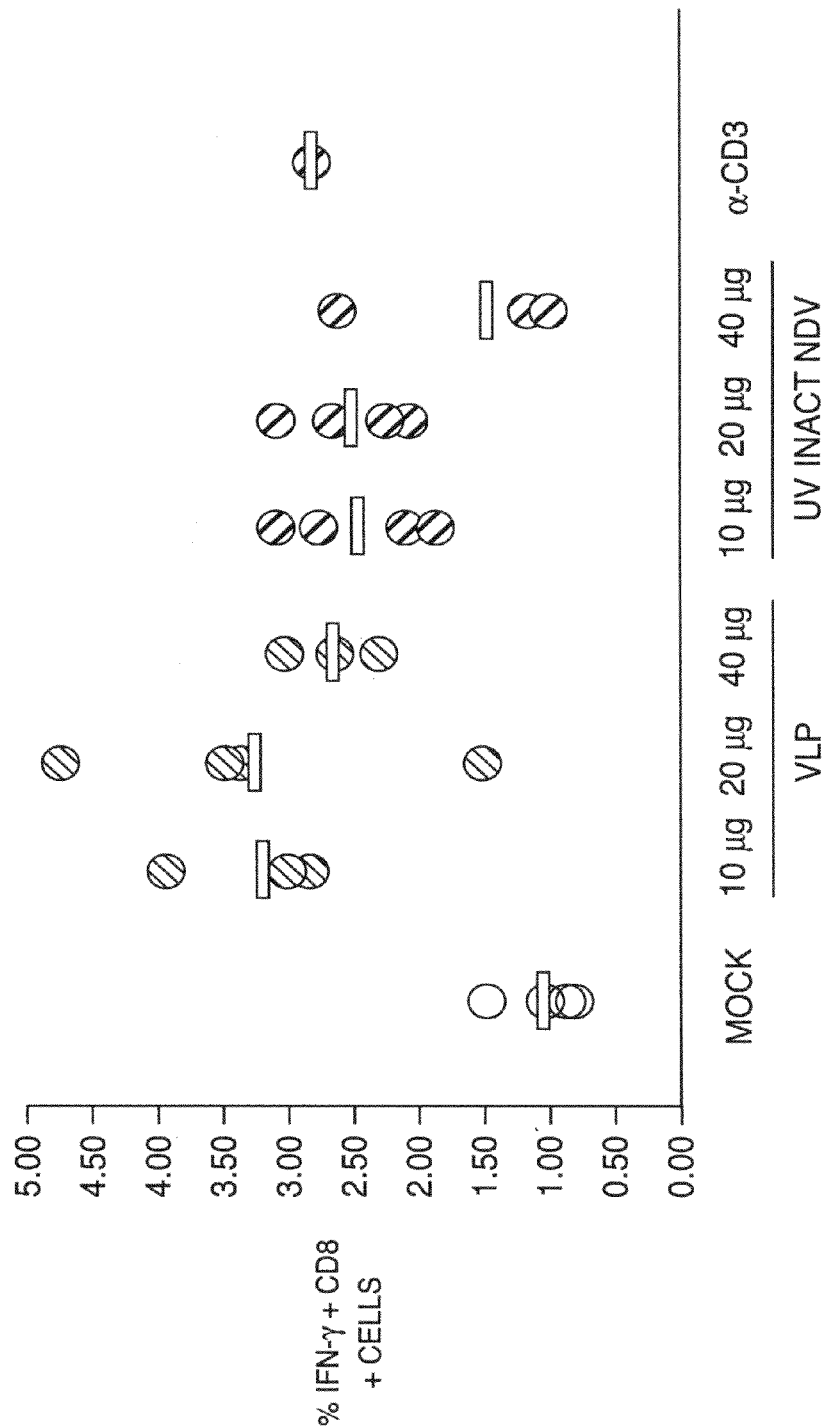
Figure 176B:
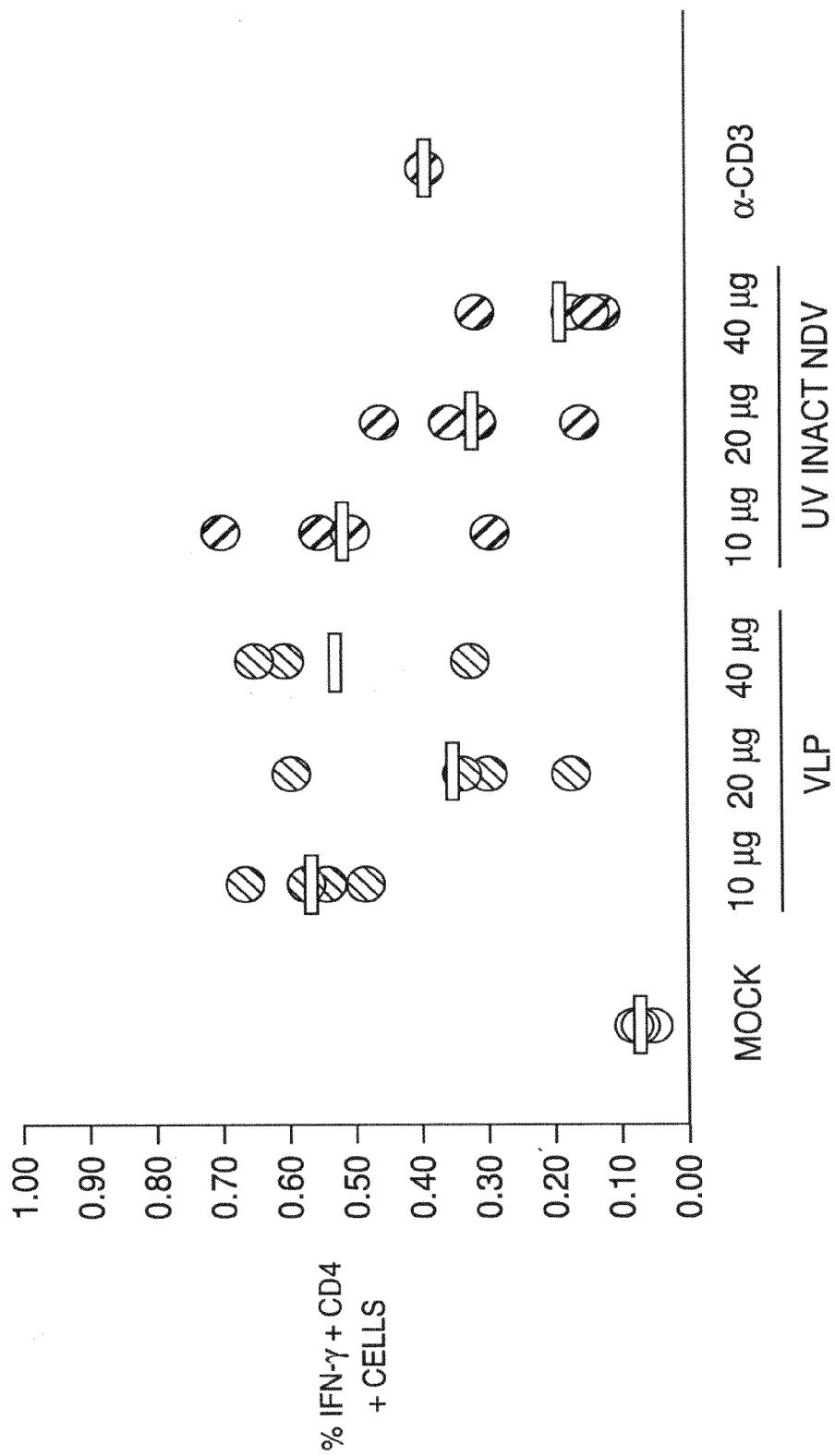

FIG. 176 shows intracellular cytokine staining of CD8+ and CD4+ cells. Spleen cells harvested from each mouse at 50 days post immunization and stimulated in vitro for 6 days with NDV infected P815 cells were strained for intracellular gamma interferon and for surface expression of either CD8 or CD4 using standard protocols. Cells were sorted by FACS and the percent of total cells positive for both CD8 and gamma interferon are shown in the left panel while the percent of total cells positive for both CD4 and gamma interferon are shown in the right panel. Results from spleen cell cultures from individual mice are shown as circles and horizontal lines indicate average values. CD3 positive cells are a positive control for stimulation.

FIG. 177 (SEQ ID NOS:379-381) shows an expression construct containing the ectodomain and TM domain from a type 1 glycoprotein of the exemplary influenza HA, and CT domain from NDV F protein.

Figure 178:
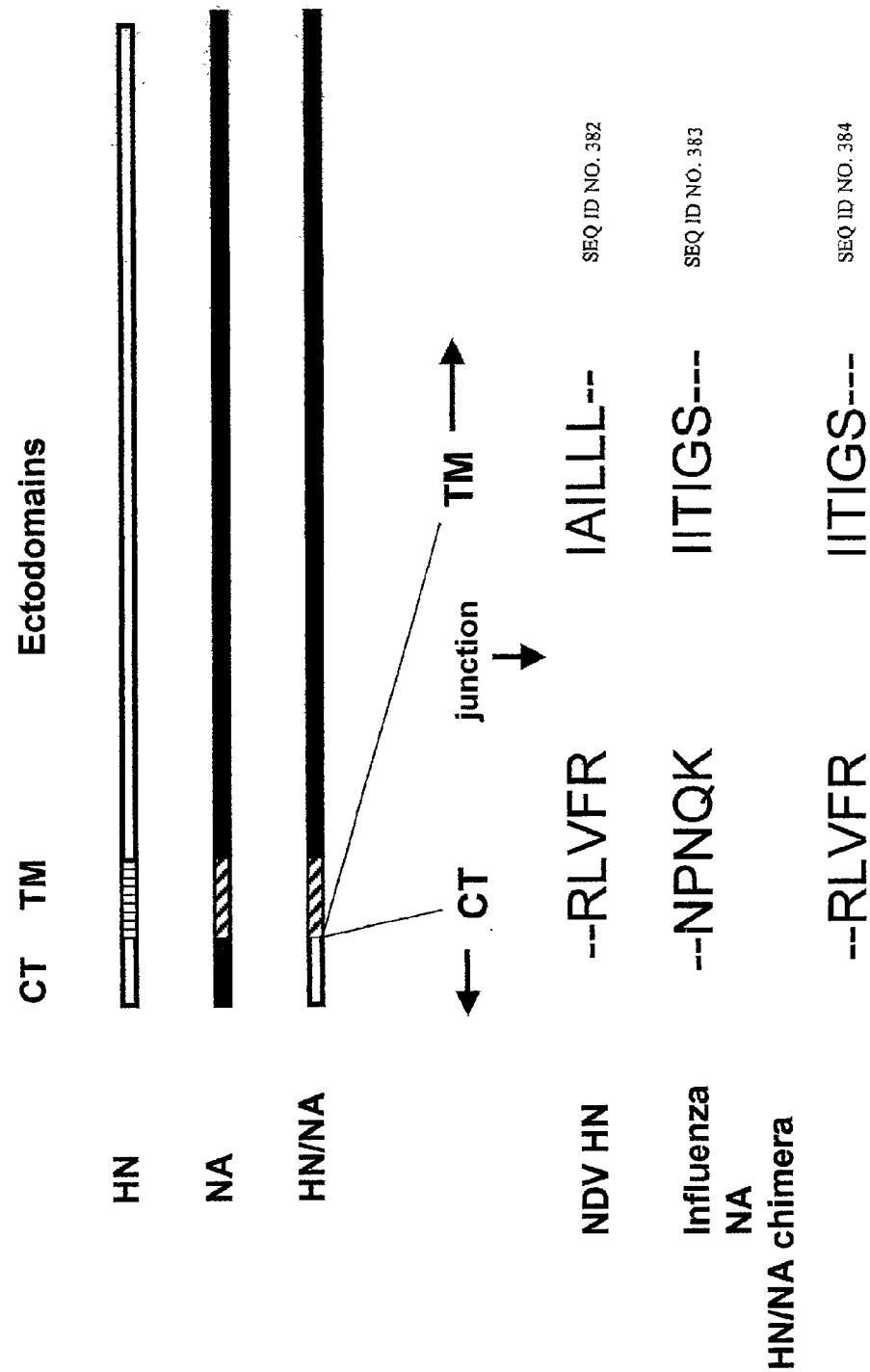

FIG. 178 (SEQ ID NOS:382-384) shows the CT domain from NDV HN, and the TM and ectodomain from a type 2 glycoprotein of the exemplary influenza NA.

FIG. 179 shows the amino acid sequence (SEQ ID NO: 185) for Fujian strain of influenza HA protein.

FIG. 180 shows the nucleotide sequence (SEQ ID NO: 208) encoding Fujian strain of influenza HA protein.

FIG. 181 shows the amino acid sequence (SEQ ID NO: 114) for Fujian strain of influenza NA protein.

FIG. 182 shows the nucleotide sequence (SEQ ID NO: 132) encoding Fujian strain of influenza NA protein.

FIG. 183 shows the amino acid sequence (SEQ ID NO: 228) for M protein from Newcastle Disease Virus (NDV) strain Hertz (GenBank Accession Number AF431744).

FIG. 184 shows the nucleotide sequence (SEQ ID NO: 239) encoding M protein from Newcastle Disease Virus (NDV) strain Hertz (GenBank Accession Number AF431744).

FIG. 185 shows the amino acid sequence (SEQ ID NO: 229) for M protein from Newcastle Disease Virus (NDV) strain B1 (GenBank Accession Number NC_002617).

FIG. 186 shows the nucleotide sequence (SEQ ID NO: 240) encoding M protein from Newcastle Disease Virus (NDV) strain B1 (GenBank Accession Number NC_002617).

FIG. 187 shows the amino acid sequence (SEQ ID NO: 230) for M protein from Newcastle Disease Virus (NDV) strain Anhing a (GenBank Accession Number AY562986).

FIG. 188 shows the nucleotide sequence (SEQ ID NO: 241) encoding M protein from Newcastle Disease Virus (NDV) strain Anhing a (GenBank Accession Number AY562986).

FIG. 189 shows the amino acid sequence (SEQ ID NO: 231) for M protein from Newcastle Disease Virus (NDV) strain dove (GenBank Accession Number AY562989).

FIG. 190 shows the nucleotide sequence (SEQ ID NO: 242) encoding M protein from Newcastle Disease Virus (NDV) strain dove (GenBank Accession Number AY562989).

FIG. 191 shows the amino acid sequence (SEQ ID NO: 232) for M protein from Newcastle Disease Virus (NDV) strain Fontana/72 (GenBank Accession Number AY562988).

FIG. 192 shows the nucleotide sequence (SEQ ID NO: 243) encoding M protein from Newcastle Disease Virus (NDV) strain Fontana/72 (GenBank Accession Number AY562988).

FIG. 193 shows the amino acid sequence (SEQ ID NO: 233) for M protein from Newcastle Disease Virus (NDV) strain Largo (GenBank Accession Number AY562990).

FIG. 194 shows the nucleotide sequence (SEQ ID NO: 244) encoding M protein from Newcastle Disease Virus (NDV) strain Largo (GenBank Accession Number AY562990).

FIG. 195 shows the amino acid sequence (SEQ ID NO: 234) for M protein from Newcastle Disease Virus (NDV) Strain LaSota (GenBank Accession Number AY845400).

FIG. 196 shows the nucleotide sequence (SEQ ID NO: 245) encoding M protein from Newcastle Disease Virus (NDV) Strain LaSota (GenBank Accession Number AY845400).

FIG. 197 shows the amino acid sequence (SEQ ID NO: 235) for M protein from Newcastle Disease Virus (NDV) Pigeon (GenBank Accession Number AJ880277).

FIG. 198 shows the nucleotide sequence (SEQ ID NO: 246) encoding M protein from Newcastle Disease Virus (NDV) Pigeon (GenBank Accession Number AJ880277).

FIG. 199 shows the amino acid sequence (SEQ ID NO: 236) for M protein from Newcastle Disease Virus (NDV), strain Italien (GenBank Accession Number EU293914).

FIG. 200 shows the nucleotide sequence (SEQ ID NO: 247) encoding M protein from Newcastle Disease Virus (NDV), strain Italien (GenBank Accession Number EU293914).

FIG. 201 shows the amino acid sequence (SEQ ID NO: 237) for M protein from Newcastle Disease Virus (NDV) strain ZJ1 (GenBank Accession Number AF431744).

FIG. 202 shows the nucleotide sequence (SEQ ID NO: 248) encoding M protein from Newcastle Disease Virus (NDV) strain ZJ1 (GenBank Accession Number AF431744).

FIG. 203 shows the amino acid sequence (SEQ ID NO: 238) for M protein from Newcastle Disease Virus (NDV), strain Ulster (GenBank Accession Number AY562991).

FIG. 204 shows the nucleotide sequence (SEQ ID NO: 249) encoding M protein from Newcastle Disease Virus (NDV), strain Ulster (GenBank Accession Number AY562991).

FIG. 205 shows the amino acid sequence (SEQ ID NO: 250) of Presenilin (human) protein (type 3 protein).

FIG. 206 shows the amino acid sequence (SEQ ID NO: 251) of an ectodomain of Influenza Virus Fujian strain HA protein.

FIG. 207 shows the amino acid sequence (SEQ ID NO: 252) of an ectodomain of CMV gB protein.

FIG. 208 shows the amino acid sequence (SEQ ID NO: 253) of an ectodomain of CMV gH protein.

FIG. 209 shows the amino acid sequence (SEQ ID NO: 254) of an ectodomain of Ebola G protein.

FIG. 210 shows the amino acid sequence (SEQ ID NO: 255) of an ectodomain of Influenza virus HA H1 protein.

FIG. 211 shows the amino acid sequence (SEQ ID NO: 256) of an ectodomain of Influenza virus B HA protein.

FIG. 212 shows the amino acid sequence (SEQ ID NO: 257) of an ectodomain of Influenza virus H3 HA protein.

FIG. 213 shows the amino acid sequence (SEQ ID NO: 258) of an ectodomain of HIV envelope protein.

FIG. 214 shows the amino acid sequence (SEQ ID NO: 259) of an ectodomain of HSV gH protein.

FIG. 215 shows the amino acid sequence (SEQ ID NO: 260) of an ectodomain of Influenza virus H7 HA protein.

FIG. 216 shows the amino acid sequence (SEQ ID NO: 261) of an ectodomain of Influenza virus H9 protein.

FIG. 217 shows the amino acid sequence (SEQ ID NO: 262) of an ectodomain of Influenza Virus H5 protein.

FIG. 218 shows the amino acid sequence (SEQ ID NO: 263) of an ectodomain of Nipah virus F protein.

FIG. 219 shows the amino acid sequence (SEQ ID NO: 264) of an ectodomain of Respiratory Syncytial virus F protein.

FIG. 220 shows the amino acid sequence (SEQ ID NO: 265) of an ectodomain of Respiratory Syncytial virus F protein.

FIG. 221 shows the amino acid sequence (SEQ ID NO: 266) of an ectodomain of SARS virus S glycoprotein.

FIG. 222 shows the amino acid sequence (SEQ ID NO: 267) of an ectodomain of Varicella Zoster Virus gB protein.

FIG. 223 shows the amino acid sequence (SEQ ID NO: 268) of an ectodomain of Varicella Zoster Virus gE protein.

FIG. 224 shows the amino acid sequence (SEQ ID NO: 269) of an ectodomain of Varicella Zoster Virus gI protein.

FIG. 225 shows the amino acid sequence (SEQ ID NO: 270) of an ectodomain of Influenza Virus Fujian strain NA protein.

FIG. 226 shows the amino acid sequence (SEQ ID NO: 271) of an ectodomain of Metapneumovirus G protein.

FIG. 227 shows the amino acid sequence (SEQ ID NO: 272) of an ectodomain of Influenza virus B NA protein.

FIG. 228 shows the amino acid sequence (SEQ ID NO: 273) of an ectodomain of Human metapneumovirus G protein.

FIG. 229 shows the amino acid sequence (SEQ ID NO: 274) of an ectodomain of Human respiratory syncytial virus G FIG. 230 shows the amino acid sequence (SEQ ID NO: 275) of an ectodomain of Influenza virus N1 NA protein.

FIG. 231 shows the amino acid sequence (SEQ ID NO: 276) of an ectodomain of Influenza virus N3 NA protein.

FIG. 232 shows the amino acid sequence (SEQ ID NO: 277) of an ectodomain of Influenza virus N2 NA protein.

FIG. 233 shows the amino acid sequence (SEQ ID NO: 278) of an ectodomain of Measles virus HA protein.

FIG. 234 shows the amino acid sequence (SEQ ID NO: 279) of an ectodomain of Mumps virus HN protein.

FIG. 235 shows the amino acid sequence (SEQ ID NO: 280) of an ectodomain of Nipah virus G protein.

FIG. 236 shows the amino acid sequence (SEQ ID NO: 281) of an ectodomain of Parainfluenza 2 virus HN protein.

FIG. 237 shows the amino acid sequence (SEQ ID NO: 282) of an ectodomain of Parainfluenza virus 3 HN protein.

FIG. 238 shows the amino acid sequence (SEQ ID NO: 283) of an ectodomain of Vaccinia virus surface protein.

FIG. 239 shows the amino acid sequences (SEQ ID NOs: 284-285) of exemplary ectodomains of Prion protein.

FIG. 240 shows the amino acid sequence (SEQ ID NO: 292) of an ectodomain of Hepatitis B virus L form of HBsAg protein.

DETAILED DESCRIPTION OF THE INVENTION

The present invention discloses methodS of making and using a novel, non-infective, paramyxovirus vaccine. Paramyxovirus structural proteins within a virus-like particle (VLP) comprise one example of such a vaccine. It is observed that the presence of matrix protein, alone, is sufficient and necessary to provide an effective VLP release. Co-expression of four paramyxovirus structural proteins, however, resultS in the release of non-infective VLPs with densities and efficiencies of release similar to that of infective particles. Representative diseases wherein a VLP vaccine might be useful include, but are not limited to, Newcastle disease, measles, respiratory syncytial virus infection, and parainfluenza 3 virus infection.

The present invention relates to the field of viral vaccines. In one embodiment, the present invention contemplates a paramyxoviral vaccine effective against diseases such as, but not limited to, Newcastle disease, measles, parainfluenza virus 3, and respiratory syncytial virus. In one embodiment, the present invention contemplates a vaccine comprising Newcastle disease virus-like particles (VLP). In one embodiment, the present invention contemplates a method comprising transfecting avian cells with cDNAs encoding major NDV structural proteins. In another embodiment, a method wherein particles resembling infectious virions are released with nearly 100% efficiency. In one embodiment, the particles are non-infective and provide a safe and effective NDV vaccine.

Paramyxoviruses have a negative, single-stranded RNA genome which is usually linear. Paramyxovirus morphology comprises a relatively spherical shape having diameters ranging between approximately 150-350 nanometers (nm). Generally, the genomes are packaged with nucleoprotein into ribonucleoprotein cores. Polymerase proteins may also be associated with these ribonucleoprotein cores which play a role in early infection replication and transcription processes. The matrix protein is a prominent feature of paramyxoviruses and lines the inner face of the viral membrane. Transmembrane proteins (i.e., for example, heamaglutinin, fusion or neuraminidase proteins) all form homo-oligomeric complexes (i.e., known in the art as spike proteins) and assist with virus assembly localized at the host cell plasma membrane. Garoff et al., "Virus Maturation By Budding" *Microbiol Mol Biol Rev* 62:1171-1190 (1998).

I. Viral Structure and Assembly

Paramyxoviruses are enveloped and known to assemble their virion components at the plasma membrane of infected cells and subsequently release progeny particles by the process of budding. Newcastle disease virus (NDV), measles, parainfluenza virus 3, and respiratory syncytial virus all belong to Paramyxoviridae, characterized as an enveloped virus with a genomic negative-stranded RNA (i.e., for example, approximately 16 KB) that is packaged with nucleoprotein into a ribonucleoprotein (RNP) core.

The paramyxovirus RNP core also contains the polymerase complex, which is composed of a Phosphoprotein and Large Polymerase. The RNP core is encased in a membrane which contains two transmembrane glycoproteins, the hemagglutinin-neuraminidase (HN) and the fusion (F) proteins, as well as the matrix (M) protein, which is associated with the inner surface of the lipid-containing viral envelope. Lamb et al., "Paramyxoviridae: The Viruses and Their Replication" pp. 1305-1340. In: *Fields Virology, Third Edition* Vol. 1., Eds: D. M. K. &. P. M. Howley, LippincottWilliams & Wilkins, Philadelphia (2001).

The matrix protein of many enveloped RNA viruses are believed to play a role in virus assembly and budding. Freed, E. O., "The HIV-TSGI01 interface: recent advances in a budding field" *Trends Microbiol.* 11:56-9 (2003); Jasenosky et al., "Filovirus budding" *Virus Res.* 106:1B1-8 (2004); Jayakar et al., "Rhabdovirus assembly and budding" *Virus Res.* 106:117-32 (2004); Peeples M. E., "Paramyxovirus M proteins: pulling it all together and taking it on the road" pp. 427-456. In: *The Paramvxoviruses*, Ed: D. W. Kingsbury, Plenum, New York, N.Y. (1991); Pomillos et al., "Mechanisms of enveloped RNA virus budding" Trends Cell Biol. 12:569-79 (2002); Schmitt et al., "Escaping from the cell: assembly and budding of negative-strand RNA viruses" *Cuff Top Microbiol Immunol* 283:145-96 (2004); and Takimoto et al., "Molecular mechanism of paramyxovirus budding" *Virus Res.* 106:133-45 (2004). However, expression of the retroviral gag precursor protein, in the absence of other viral components, also results in the assembly and release of gag virus-like particles (VLPs) from the plasma membrane. Delchambre et al., "The GAG precursor of simian immunodeficiency virus assembles into virus-like particles" *EMBO J.* 8:2653-60 (1989); Demirov et al., "Retrovirus budding" *Virus Res* 106:87-102 (2004); Gheysen et al., "Assembly and release of HIV-1 precursor Pr55gag virus-like particles from recombinant baculovirus-infected insect cells" *Cell* 59:103-12 (1989); and Morita et al., "Retrovirus budding" *Annu Rev Cell Dev Biol.* 20:395-425 (2004). It has been unclear, therefore, which NDV proteins are sufficient and necessary to direct viral particle formation and release.

A. M Proteins

In one embodiment, the present invention contemplates a method comprising an M protein from a paramyxovirus, without any additional glycoproteins, wherein VLPs are created.

M proteins isolated from:

i) Ebola virus (Jasenosky et al., "Filovirus budding" *Virus Res.* 106:1B1-8 (2004); Jasenosky et al., "Ebola virus VP40-induced particle formation and association with the lipid bilayer" *J. Virol.* 75:5205-14 (2001); and Timmins et al., "Vesicular release of Ebola virus matrix protein VP40" *Virology* 283: 1-6 (2001));

ii) vesicular stomatitis virus (Jayakar et al., "Rhabdovirus assembly and budding" *Virus Res.* 106:117-32 (2004); Li et al., "Viral liposomes released from insect cells infected with recombinant baculovirus expressing the matrix protein of vesicular stomatitis virus" *J. Virol.* 67:4415-20 (1993); and Sakaguchi et al., "Double-layered membrane vesicles released from mammalian cells infected with Sendai virus expressing the matrix protein of vesicular stomatitis virus" *Virology* 263:230-43 (1999))

and, iii) influenza virus (Gomez-Puertas et al., "Influenza virus matrix protein is the major driving force in virus budding" *J. Virol.* 74:11538-47 (2000)), when expressed alone, assemble into and are released as VLPs.

Conversely, M protein-deficient rabies virus is known to be severely impaired in virion formation. Mebatsion et al., "Matrix protein of rabies virus is responsible for the assembly and budding of bullet-shaped particles and interacts with the transmembrane spike glycoprotein G" *J. Virol.* 73:242-50 (1999).

Studies in several paramyxovirus systems have also suggested a role for the M protein in virus assembly and budding. Measles virus (MV) and Sendai virus (SV) modified by reverse genetics to lack the M protein genes were impaired in budding. Cathomen et al., "A matrix-less measles virus is infectious and elicits extensive cell fusion: consequences for propagation in the brain" *EMBO J.* 17:3899-3908 (1998); and Inoue et al., "A new Sendai virus vector deficient in the matrix gene does not form virus particles and shows extensive cell-to-cell spreading" *J. Virol.* 77:6419-29 (2003), respectively. Moreover, MV containing mutant M protein derived from subacute sclerosing panencephalitis (SSPE) virus was also defective in budding. Patterson et al., "Evidence that the hypermutated M protein of a subacute sclerosing panencephalitis measles virus actively contributes to the chronic progressive CNS disease" *Virology* 291:215-25 (2001).

Recent studies of paramyxovirus assembly have also focused on identifying the viral protein requirements for assembly and budding of VLPs and have demonstrated a role for the M protein. The human parainfluenza virus type 1 (hPIV1) M protein and the SV M protein expressed alone induced budding of VLPs from the plasma membrane. Coronel et al., "Human parainfluenza virus type 1 matrix and nucleoprotein genes transiently expressed in 12 mammalian cells induce the release of virus-like particles containing 13 nucleocapsid-like structures" *J. Virol.* 73:7035-8 (1999); Sakaguchi et al., "Double-layered membrane vesicles released from mammalian cells infected with Sendai virus expressing the matrix protein of vesicular stomatitis virus" *Virology* 263: 230-43 (1999); Sugahara et al., "Paramyxovirus Sendai virus-like particle formation by expression of multiple viral proteins and acceleration of its release by C protein" *Virology* 325:1-10 (2004); and Takimoto et al., "Role of matrix and fusion proteins in budding of Sendai virus" *J. Virol.* 75: 11384-91 (2001). Expression of M protein was also required for Simian Virus 5 (SV5) VLP formation. Schmitt et al., "Requirements for budding of paramyxovirus simian virus virus-like particles" *J Virol* 76:3952-64 (2002).

However, in contrast to PIY1 and SV, the SV5 M protein was not sufficient for VLP release. Rather, simultaneous expression of SV5 M protein, together with NP and either of the glycoproteins was required. Although existing reports agree upon a role for M protein as a budding organizer in paramyxovirus particle release, there are differences in the protein requirements for assembly and budding of virions. The budding capacities of retrovirus gag protein, Ebola virus M protein, and influenza M1 protein are attributed, in part, to Late Domains (infra). Demirov et al., "Retrovirus budding"

Virus Res 106:87-102 (2004); Freed, E. O., "Viral late domains" *J. Virol.* 76:4679-87 (2002); Jasenosky et al., "Filovirus budding" *Virus Res.* 106:1B1-8 (2004); Jayakar et al., "Rhabdovirus assembly and budding" *Virus Res.* 106: 117-32 (2004); Morita et al., "Retrovirus budding" *Annu Rev Cell Dev Biol.* 20:395-425 (2004); Nayak et al., "Assembly and budding of influenza virus" *Virus Res* 106:147-65 (2004); Pomillos et al., "Mechanisms of enveloped RNA virus budding" *Trends Cell Biol.* 12:569-79 (2002); Schmitt et al., "Escaping from the cell: assembly and budding of negative-strand RNA viruses" *Cuff Top Microbiol Immunol* 283:145-96 (2004); Strack et al., "AlP 1/ALIX is a binding partner for HIV-1 p6 and EIA V p9 functioning in virus budding" *Cell* 114:689-99 (2003); and von Schwedler et al., "The protein network of HIV budding" *Cell* 4:701-13 (2003).

B. Late Domains

Late Domains are short peptide motifs that mediate interactions with a member of the class E proteins, which are involved in the vacuolar protein sorting (VPS) pathway. The Late Domain promotes budding by interacting with components of the cellular machinery responsible for sorting cargo into multivesicular bodies (MVB). The formation of MVB vesicles and the budding of a virus are topologically similar processes. Available evidence suggests that enveloped RNA viruses bud by co-opting the cellular machinery that is normally used to create MVB inside the cell. Carter, C. A., "Tsg101: HIV-1 's ticket to ride" *Trends Microbiol.* 10:203-205 (2002); Demirov et al., "Retrovirus budding" *Virus Res* 106:87-102 (2004); Freed, E. O., "The HIV-TSGI01 interface: recent advances in a budding field" *Trends Microbiol.* 11:56-9 (2003); Freed, E. O., "Viral late domains" *J. Virol.* 76:4679-87 (2002); Garrus et al., "Tsg 1-01 and the vacuolar protein sorting pathway are essential for HIV-1 budding" *Cell* 107:55-65 (2001); Morita et al., "Retrovirus budding" *Annu Rev Cell Dev Biol.* 20:395-425 (2004); Pornillos et al., "Mechanisms of enveloped RNA virus budding" *Trends Cell Biol.* 12:569-79 (2002); Pornillos et al., "HN Gag mimics the TsgI01-recruiting activity of the human Hrs protein" *J Cell Biol* 162:425-34 (2003); Strack et al., "AlP 1/ALIX is a binding partner for HIV-1 p6 and EIA V p9 functioning in virus budding" *Cell* 114:689-99 (2003); von Schwedler et al., "The protein network of HIV budding" *Cell* 4:701-13 (2003). Martindale, D., "Budding viral hijackers co-opt the endocytic machinery to make a getaway" *J. Biol.* 3:2 (2003); and Simons et al., "The budding mechanisms of enveloped animal viruses" *J. Gen. Virol.* 50:1-21 (1980).

In one embodiment, the present invention contemplates that dominant negative mutant protein component of the VPS pathway may also inhibit particle release. In one embodiment, an YXXL (SEQ ID NO:3) sequence in the NDV M protein has properties of a Late Domain. Although it is not necessary to understand the mechanism of an invention, it is believed that the YXXL mutation abolishes particle release while substitution of late domains such as YPDL and/or PTAP fully restore particle release.

C. Budding

Within the paramyxovirus family, it is known that the VPS pathway is involved in the SV5 budding. It was shown that a dominant-negative mutation VPS4(E228Q) (an ATPase required for recycling protein complexes involved in the VPS pathway) inhibited budding of SV5 virions as well as VLPs. Schmitt et al., "Evidence for a new viral late-domain core sequence, FPIV, necessary for budding of a paramyxovirus" *J. Virol.* 79:2988-97 (2005). Since it is known that VPS4 (E228Q) also inhibits the VPS pathway, one may believe that the VPS pathway is involved in SV5 budding. In addition, a putative Late Domain in SV5 M was identified. However, SV5 M protein is not sufficient for VLP formation and release, complicating the interpretation of this result. Thus, the general rules for assembly and release of paramyxoviruses are not yet clear. Schmitt et al., "Requirements for budding of paramyxovirus simian virus virus-like particles" *J Virol* 76:3952-64 (2002). Open questions include: i) the further definition of paramyxovirus late domains in viral structural proteins, ii) the role or contribution of each viral protein in virus assembly, and iii) the cellular factors involved in the assembly and budding process.

Various embodiments of the present invention answer these questions. In one embodiment, the present invention contemplates a method for producing NDV VLPs from cells transfected with nucleic acids encoding viral structural proteins. In another embodiment, the present invention contemplates transfecting with nucleic acid encoding an NDV M protein that is both necessary and sufficient for release of lipid-containing particles (i.e., for example VLPs). In another embodiment, the present invention contemplates that the most efficient incorporation (i.e., for example, almost 100%) of other viral proteins into VLPs requires the expression of M protein with at least two other NDV proteins. For example, it is known that dominant-negative mutations of CHMP3 and Vps4 proteins (both components of the host VPS system) inhibited release of VLPs. Morita et al., "Retrovirus budding" *Annu Rev Cell Dev Biol.* 20:395-425 (2004); Strack et al., "AlP 1/ALIX is a binding partner for HIV-1 p6 and EIA V p9 functioning in virus budding" *Cell* 114:689-99 (2003); and von Schwedler et al., "The protein network of HIV budding" *Cell* 4:701-13 (2003). It is further contemplated that AIP1 is also incorporated into VLPs thereby playing a role in NDV particle budding.

D. Dominant Negative Mutations

The dominant negative Vps4 protein may block release of SV5 virions or VLPs composed of NP, HN, F, and M proteins, implicating the VPS system in paramyxovirus release. Schmitt et al., "Evidence for a new viral late-domain core sequence, FPIV, necessary for budding of a paramyxovirus" *J. Virol.* 79:2988-2997 (2005). Confirming these results, a dominant negative version of Vps4, Vps4 A-E228Q, blocked NDV VLP release. Martin-Serrano et al., "Role of ESCRT-I in retroviral budding" *J Virol* 77:4794-4804 (2003); Strack et al., "AIP1/ALIX is a binding partner for HIV-1 p6 and EIAV p9 functioning in virus budding" *Cell* 114:689-699 (2003); and von Schwedler et al., "The protein network of HIV budding" *Cell* 114:701-713 (2003)).

Although it is not necessary to understand the mechanism of an invention, it is believed that the results demonstrated herein show that these dominant negative proteins blocked release of particles containing only M protein. For example, a dominant negative version of CHMP3, a subunit of the ESCRT III complex (1), and a dominant negative mutant of AIP1, a protein that binds both ESCT I and III proteins, inhibited NDV VLP release as well as release of particles containing only M protein. This inhibition was not due to over expression of the protein since transfection of the wild type versions of these proteins had little effect on M particle release. These results show that an intact VPS pathway facilitates NDV VLP budding. Furthermore, these results indicate that the VPS pathway is involved in M particle release.

Many studies have demonstrated that L domains in the matrix proteins of viruses mediate their interaction with specific molecules of the VPS pathway. Bieniasz, P. D., "Late budding domains and host proteins in enveloped virus release" *Virology* 344:55-63 (2006); Freed, E. O., "Viral late domains" *J. Virol.* 76:4679-4687 (2002); and Morita et al., "Retrovirus budding" *Annu Rev Cell Dev Biol* 20:395-425

(2004). Three L domain motifs, PTAP, YPXL, and PPXY (Pomillos et al., "Mechanisms of enveloped RNA virus budding" *Trends Cell Biol.* 12:569-579 (2002)), have been identified in retroviruses (Puffer et al., "Equine infectious anemia virus utilizes a YXXL motif within the late assembly domain of the Gag p9 protein" *J Virol* 71:6541-6546 (1997)), rhabdoviruses and filoviruses (Irie et al., "Budding of PPxY-containing rhabdoviruses is not dependent on host proteins TGS101 and VPS4A" *J Virol* 78:2657-2665 (2004)). An YRKL sequence has been identified as a late domain in orthomyxoviruses (Hui et al., "YRKL sequence of influenza virus M1 functions as the L domain motif and interacts with VPS28 and Cdc42" *J Virol* 80:2291-2308 (2006)).

Binding of the PTAP sequence to TSG101 (tumor susceptibility gene 101) protein, a component of ESCRT I, has been reported. Huang et al., "p6Gag is required for particle production from full-length human immunodeficiency virus type 1 molecular clones expressing protease" *J Virol* 69:6810-6818 (1995). Further, the YPXL sequence has been shown to interact with AP2 (adaptor protein 2) and AIP1. Chen et al., "Functions of early (AP-2) and late (AIP1/ALIX) endocytic proteins in equine infectious anemia virus budding" *J Biol Chem* (2005); and Strack et al., "AIP1/ALIX is a binding partner for HIV-1 p6 and EIAV p9 functioning in virus budding" *Cell* 114:689-699 (2003), respectively. The YRKL sequence in the influenza virus M1 protein binds to VSP28, an ESCRT 1 protein that binds tsg101, as well as Cdc42, a member of the Rho family of GTP-binding proteins. The PPXY motif binds to Nedd4-like (neural precursor cell expressed, developmentally down regulated gene 4) ubiquitin ligases. Vana et al., "Role of Nedd4 and ubiquitination of Rous sarcoma virus Gag in budding of virus-like particles from cells" *J Virol* 78:13943-13953 (2004); and Xiang et al., "Fine mapping and characterization of the Rous sarcoma virus Pr76gag late assembly domain" *J Virol* 70:5695-5700 (1996)).

Paramyxovirus M proteins do not have a PTAP, an YPXL, an YRKL, or a PPXY motif. The sequence FPIV, however, in the SV5 M protein may be a late domain in paramyxoviruses. Mutation of FPIV inhibited release of particles and addition of this sequence in a retrovirus gag construct stimulated the release of particles. However, since the SV5 M protein is not sufficient for SV5 particle release, FPIV is not believed to function independently as a late domain in the context of this paramyxovirus M protein. Schmitt et al., "Evidence for a new viral late-domain core sequence, FPIV, necessary for budding of a paramyxovirus" *J. Virol.* 79:2988-2997 (2005).

Thus, it is not clear how SV5 uses the VPS pathway or how the FPIV sequence might function as a late domain. Sequence analysis of the NDV M protein shows the presence of this FPIV motif. In addition, NDV M protein contains a PKSP and a YANL sequence, not found in the SV5 M protein. In one embodiment, the present invention contemplates a YANL motif comprising properties of an L domain. In one embodiment, a YANL mutation reduces M protein particle release. Although it is not necessary to understand the mechanism of an invention, it is believed that substitution of a YANL mutation with other known late domains (i.e., for example, PTAP or YPDL) particle release may become fully restored.

It is further believed that inhibition of particle release by mutation of the YANL sequence is not likely due only to effects on protein folding. The data provided herein suggests that the NDV M protein may access the VPS pathway using either type of late domain, an YPDL or a PTAP domain and that the FPIV sequence in the NDV M protein may not function as a late domain independent of the YANL sequence since the YANL mutant protein M-$A_{232}$-$A_{235}$ has a wild type FPIV sequence.

YPDL late domains have been shown to interact with the VPS protein AIP1. In one embodiment, the present invention contemplates that AIP1 protein is found in released particles containing only M protein.

The M protein of Sendai virus has also been shown to be sufficient for release of particles (Sugahara et al., "Paramyxovirus Sendai virus-like particle formation by expression of multiple viral proteins and acceleration of its release by C protein" *Virology* 325:1-10 (2004); and Takimoto et al., "Role of matrix and fusion proteins in budding of Sendai virus" *J. Virol.* 75:11384-11391 (2001)). The Sendai virus M protein has an YLDL sequence, which could serve as a late domain for SV M protein. As noted above, the SV5 M protein is not sufficient for release of neither particles nor does it has an YXXL motif. Schmitt et al., "Requirements for budding of paramyxovirus simian virus 5 virus-like particles" *J Virol* 76:3952-3964 (2002). However, the SV5 NP protein has a number of YXXL motifs including a YPLL sequence. Alternatively, an SV5 late domain may be present on the SV5 NP rather than the M protein. Indeed, it has been reported that SV5 VLP release is significantly enhanced by the expression of the SV5 NP protein with M protein as well as a glycoprotein. Schmitt et al., "Requirements for budding of paramyxovirus simian virus 5 virus-like particles" *J Virol* 76:3952-3964 (2002). Consequently, it is clear that differential requirements for the release of particles in different paramyxovirus systems exist and may be due in part to different distributions of the late domains on structural proteins. Nevertheless, the present invention contemplates that the host cell VPS pathway facilitates M protein budding and that the YANL motif in the NDV M protein has the properties of a late domain.

II. Virus-Like Particle (VLP) Formation and Release

In one embodiment, the present invention contemplates transfecting a host cell with nucleic acid encoding only a paramyxovirus M protein so that the transfected cells express the matrix protein and create paramyxoviral VLPs. In another embodiment, the present invention contemplates co-expression of two or more paramyxovirus glycoproteins including, but not limited to, NP, F-K115Q, and/or HN proteins (together with M protein) under conditions such that paramyxovirus VLP formation and release occurs.

The present invention contemplates conditions for the efficient generation of VLPs of a virulent paramyxoviral strain. In one embodiment, the paramyxoviral strain comprises the group including, but not limited to, Newcastle disease, measles, parainfluenza virus 3, or respiratory syncytial virus. In another embodiment, the VLPs comprise the same major antigens as infectious virus. In another embodiment, the VLPs comprise major antigens having the same ratios as infectious virus. In one embodiment, the major antigens are selected from the group comprising nucleocapsid protein, membrane/matrix protein, hemagglutinin-neuraminidase protein, and fusion protein.

The production of VLPs in accordance with embodiments of the present invention is much simpler and likely more cost effective than currently available live or attenuated virus vaccines. VLPs can be harvested from cell supernatants and purified by the same protocols used to purify virus. VLPs can be engineered to increase the spectrum of immune responses. The VLPs can also be engineered so that the immune response can be distinguished from that induced by an infection.

A. VLP Release Characteristics

In one embodiment, VLPs are released from cells co-expressing the major structural proteins of paramyxoviruses. In one embodiment, NDV VLP particles are released from a chicken fibroblast cell line co-expressing NP, M, F and HN proteins that can be purified and characterized. In one embodiment, an uncleaved version of F protein eliminated any potential effects of cell-to-cell fusion on virus release. In one embodiment, avian cells are used because birds are the natural host of NDV. For example, as detailed in the Examples below, cells (i.e., for example, avian or human) were co-transfected with plasmids encoding NDV viral proteins using concentrations of DNA previously determined to result in expression levels and ratios of proteins comparable to infected cells. Cells were then pulse-labeled with $^{35}$S-methionine and $^{35}$S-cysteine and then chased for 8 hours (a time also resulting in maximal particle release). VLPs in the cell supernatants were isolated and fractionated by sucrose density ultracentrifugation.

In one embodiment, the efficiency of paramyxoviral VLP release from cells expressing at least four viral proteins (85%) was comparable to the efficiency of infectious particle release from paramyxovirus-infected cells (92%). Although it is not necessary to understand the mechanism of an invention, it is believed that this result suggests that four paramyxovirus proteins (i.e., for example, M protein, NP protein, F, protein, or HN protein) may provide an efficient formation of particles. It is further believed that the viral Large Polymerase or Phosphoprotein proteins have little quantitative effect on virus release.

Although it is not necessary to understand the mechanism of an invention, it is believed that paramyxoviral VLPs, which can be isolated on sucrose gradients, have a relatively homogeneous density that is slightly less than the average density of an authentic virus. Although it is not necessary to understand the mechanism of an invention, it is believed that this result is likely due to the absence of the viral genomic RNA in the particles. It is further believed, therefore, that the VLPs are non-infectious.

Although it is not necessary to understand the mechanism of an invention, it is believed that paramyxoviral VLPs are likely folded into conformations virtually identical to an authentic virus and are packaged into particles in a manner identical to paramyxoviral particles. As a result, these particles should be as antigenic as authentic virus. VLPs do not, however, contain the viral genome, since the cells (i.e., for example, avian or human), which are forming and releasing these particles, are not infected with virus. Therefore, VLPs cannot be infectious and cannot cause disease.

B. M Protein Function

In one embodiment, a paramyxovirus M protein is both sufficient and necessary for VLP particle release. In one embodiment, the paramyxovirus is selected from the group including, but not limited to, Newcastle disease virus, measles virus, parainfluenza virus 3, and syncytial respiratory virus. That is to say, expression of the M protein alone resulted in very efficient release of M protein containing paramyxovirus VLP particles. For example, the efficiency of M protein release is comparable to that observed when at least four proteins were co-expressed. Although it is not necessary to understand the mechanism of an invention, it is believed that this result suggests that it is the M protein that directs the budding of paramyxovirus VLPs. Furthermore, VLPs are released when only M protein is present. Consequently, significant VLP particle release will not occur the absence of M protein even if viral protein expression (or co-expression of a combination of viral proteins) is present. For example, cells expressing HN protein, alone, released only trace amounts of a very light density HN protein-containing material into cell supernatants, and it is unlikely that this material reflects a significant component of virus assembly. In one embodiment, the present invention contemplates that no NDV protein, other than M protein, can function independently in the release of lipid containing particles that reflect virus assembly.

Although it is not necessary to understand the mechanism of an invention, it is believed that VLP particles released from cells expressing only M protein have very heterogeneous densities because this budding occurs indiscriminately from different cell membranes or from different plasma membrane domains and, consequently, contain different lipid-to-protein ratios due to variable M protein oligomerization. For example, particles formed from monomer M protein may have a higher lipid to protein ratio than particles formed from M protein in an oligomeric state. It is known that M proteins of other negative stranded RNA viruses can form oligomeric structures. Garoff et al., "Virus maturation by budding" *Microbiol Mol Biol Rev* 62:1171-90 (1998); and Panch et al., "In vivo oligomerization and raft localization of Ebola virus protein VP40 during vesicular budding" *Proc Natl Acad Sci USA* 100: 15936-41 (2003).

C. Glycoprotein Function

Formation of infectious paramyxovirus virions is believed to involve the incorporation of both the HN and F glycoproteins. In one embodiment, the present invention contemplates a composition comprising glycoprotein incorporation into a paramyxovirus VLP when M protein is co-expressed with at least two glycoproteins. Single glycoprotein co-expression (i.e., for example HN+M or F+M) resulted in only trace amounts of either HN or F glycoprotein incorporated into VLP particles. Further, when HN and F glycoproteins were co-expressed with M protein, the glycoprotein incorporation levels were comparable to that observed with co-expression of at least four proteins.

Although it is not necessary to understand the mechanism of an invention, it is believed that these results indicate that the M protein binds more efficiently with a complex of HN and F glycoproteins. This possibility is also supported by observations that co-expression of these two glycoproteins with M protein resulted in paramyxovirus VLPs having a more homogenous and decreased density. M protein VLP particles generally have a very heterogeneous density. Co-expression of M protein with either glycoprotein, alone, did not change the general density of M protein containing particles. It is believed that these results indicate that interactions of M protein with an HN-F protein complex affected the protein to lipid ratio of the VLPs or affected the membrane from which the particles were released.

It should be noted that not just any combination of M protein and viral glycoproteins produce paramyxovirus VLPs in good yield as contemplated herein. For example, co-expression of a single glycoprotein and an M protein results in a 40-60% VLP release suppression when compared to VLP release observed after: i) co-expression with all four proteins; ii) expression of an M protein with at least two glycoproteins; and iii) expression of M protein alone. Empirical studies revealed that this release suppression is relieved by co-expression of M protein with NP and another glycoprotein.

Although it is not necessary to understand the mechanism of an invention, it is believed that VLP release suppression by a single glycoprotein+M protein is consistent with observations that NP+M protein VLP release is: i) 70% lower when compared to release from cells expressing at least four proteins; and ii) 80% lower when compared to release from cells expressing only M protein. Although it is not necessary to understand the mechanism of an invention, it is believed that the large amount of NP in the cytoplasm may pull M protein away from the plasma membrane, thereby preventing its association with this membrane and, therefore, budding of particles. Consequently, one hypothesis suggests that co-expression with another glycoprotein may redirect both NP and M protein to a cellular membrane thereby relieving VLP release suppression.

D. Vacuolar Protein Sorting (VPS) System and Multivesicular Buds (MVBs)

Although it is not necessary to understand the mechanism of an invention, it is believed that paramyxovirus M protein-dependent VLP release uses the host vacuolar protein sorting (VPS) system. The VPS system has been reported to mediate budding of other enveloped viruses. Morita et al., "Retrovirus budding" *Annu Rev Cell Dev Biol.* 20:395-425 (2004); and Pornillos et al., "Mechanisms of enveloped RNA virus budding" *Trends Cell Biol.* 12:569-79 (2002).

Budding of retroviruses, filoviruses, and influenza viruses are thought to depend upon the host cell VPS pathway. The VPS pathway also serves to form MVBs. Demirov et al., "Retrovirus budding" *Virus Res* 106:87-102 (2004); Jasenosky et al., "Filovirus budding" *Virus Res.* 106:1B1-8 (2004); Morita et al., "Retrovirus budding" *Annu Rev Cell Dev Biol.* 20:395-425 (2004); Pornillos et al., "Mechanisms of enveloped RNA virus budding" *Trends Cell Biol.* 12:569-79 (2002); Freed, E. O., "Viral late domains" *J. Virol.* 76:4679-87 (2002); and Schmitt et al., "Escaping from the cell: assembly and budding of negative-strand RNA viruses" *Cuff Top Microbiol Immunol* 283:145-96 (2004). MVBs are formed by invagination of endosomal membranes into the endosomallumen thereby creating a vesicle inside a vesicle. Martindale, D., "Budding viral hijackers co-opt the endocytic machinery to make a getaway" *J Biol.* 3:2 (2003). The topology of MVB formation is similar to that of virus budding from plasma membrane.

It has been proposed that viral proteins usurp this host cell machinery to direct virus budding. Demirov et al., "Retrovirus budding" *Virus Res* 106:87-102 (2004); Martindale, D., "Budding viral hijackers co-opt the endocytic machinery to make a getaway" *J Biol.* 3:2 (2003); and Morita et al., "Retrovirus budding" *Annu Rev Cell Dev Biol.* 20:395-425 (2004). Currently, research suggests that the formation of MVBs involves three protein complexes, first characterized in yeast, and are collectively known as the Endosomal Sorting Complexes Required for Transport (i.e., for example, ESCRT I, II, and III). Babst et al., "ESCRT-III: an endosome-associated heterooligomeric protein complex 4 required for MVB sorting" *Dev Cell* 3:271-282 (2002); Jiang et al., "Multivesicular bodies: a mechanism to package lytic and storage functions in one organelle?" *Trends Cell Biol.* 12:362-7 (2002); Katzmann et al., "Ubiquitin-dependent sorting into the multivesicular body pathway requires the function of a conserved endosomal protein sorting complex, ESCRT-I" *Cell* 106:145-55 (2001); and Katzmann et al., "Vps27 recruits ESCRT machinery to endosomes during MVB sorting" *J Cell Biol.* 162:413-23 (2003). In addition, Vps4 protein (i.e., for example, an ATPase) is required for the dissociation of the full ESCRT complex. Raiborg et al., "Protein sorting into multivesicular endosomes" *Cuff Opin Cell Biol* 15:446-55 (2003).

E. VLP Release Inhibition

Studies with a number of virus types, most prominently retroviruses, have shown that cellular proteins involved in the formation of MVBs are recruited by retrovirus gag proteins and other matrix-like proteins by interactions of viral Late Domains with a component of the VPS pathway. Demirov et al., "Retrovirus budding" *Virus Res* 106:87-102 (2004); Morita et al., "Retrovirus budding" *Annu Rev Cell Dev Biol.* 20:395-425 (2004); Pomillos et al., "Mechanisms of enveloped RNA virus budding" *Trends Cell Biol.* 12:569-79 (2002); 44. It has been found that dominant negative mutants of Vps4, CHMP3, and CHMP2 can block retrovirus release. Strack et al., "PIP1/ALIX is a binding partner for HIV-1 p6 and EIAV p9 functioning in virus budding" Cell 114:689-699 (2003).

Although it is not necessary to understand the mechanism of an invention, it is believed that a dominant-negative mutation of Vps4 or Vps4 A-E228Q is capable of blocking M protein paramyxovirus VLP release. It is further believed that a dominant-negative mutation of CHMP3 (i.e., for example, a subunit of the ESCRT III complex) inhibits M protein paramyxovirus VLP release. These observations indicate not only that the VPS pathway is involved in paramyxoviral budding (i.e., for example, VLP release) but that it is the M protein that directly interacts with the VPS pathway.

It has recently been reported that SV5 VLP and virion release are also inhibited by expression of the dominant negative form of VSP4 implicating the VPS pathway in SV5 assembly and release. Schmitt et al., "Evidence for a new viral late-domain core sequence, FPIV, necessary for budding of a paramyxovirus" *J. Virol.* 79:2988-97 (2005). Furthermore, the sequence FPIV (SEQ ID NO:1) in the SV5 M protein is believed to be a Late Domain. The SV5 M protein, however, is known not to be sufficient for particle release. Schmitt et al., "Requirements for budding of paramyxovirus simian virus virus-like particles" *J Virol* 76:3952-64 (2002). Consequently, it is not clear how SV5 uses the VPS pathway or how this sequence might function as a Late Domain.

In one embodiment, a sequence analysis of an NDV M protein also shows the presence of an FPIV motif (SEQ ID NO:1). In one embodiment, an NDV M protein further comprises a PXXP motif (SEQ ID NO:2) and an YXXL motif (SEQ ID NO:3), sequences not found in the SV5 M protein. Other motifs identified in the art might also be candidate Late Domains for other paramyxovirus M proteins; i.e., domains that could function in budding independent of other viral proteins. Demirov et al., "Retrovirus budding" *Virus Res* 106:87-102 (2004); and Freed, E. O., "Viral late domains" *J. Virol.* 76:4679-87 (2002).

F. Host-Specific VLP Expression

Virus-like particle expression from human 293T cells have been reported in three other paramyxovirus systems (Sendai virus (SV), PIV1, and SV5) at efficiencies ranging between 18% to 70%. Schmitt et al., "Requirements for budding of paramyxovirus simian virus virus-like particles" *J Virol* 76:3952-64 (2002); Sugahara et al., "Paramyxovirus Sendai virus-like particle formation by expression of multiple viral proteins and acceleration of its release by C protein" *Virology* 325:1-10 (2004); and Takimoto et al., "Role of matrix and fusion proteins in budding of Sendaivirus" *J. Virol.* 75:11384-91 (2001).

In one embodiment, the present invention contemplates a method comprising improving the efficiency of paramyxovirus VLP release by using cells from the natural host of the virus. In one embodiment, a paramyxovirus is selected from the group including, but not limited to, Newcastle disease virus, measles virus, parainfluenza virus 3, or respiratory syncytial virus. In one embodiment, a M protein paramyxovirus VLP is released from avian cells with an efficiency of 90%. In another embodiment, M protein paramyxovirus VLP is released from human 293T cells with an efficiency of 50%. Furthermore, the efficiency of release of both M protein VLPs, as well as complete VLPs, from COS cells was significantly lower than release from avian cells; a difference that is not due to a lower expression level of viral proteins in COS cells versus avian cells. Although it is not necessary to understand the mechanism of an invention, it is believed that differences between the efficiencies of paramyxovirus VLP formation may be due to a host cell-specific dependency.

It is known that the protein requirements for VLP formation in other paramyxovirus systems also vary. For example, paramyxovirus systems comprising M proteins of SV, hPIV1 and SV5 are considered involved in directing virus assembly and budding, but there are differences in the role of M protein in actual particle formation. Coronel et al., "Human parainfluenza virus type 1 matrix and nucleoprotein genes transiently expressed in 12 mammalian cells induce the release of virus-like particles containing 13 nucleocapsid-like structures" *J. Virol.* 73:7035-8 (1999); Schmitt et al., "Requirements for budding of paramyxovirus simian virus virus-like particles" *J Virol* 76:3952-64 (2002); Sugahara et al., "Paramyxovirus Sendai virus-like particle formation by expression of multiple viral proteins and acceleration of its release by C protein" *Virology* 325:1-10 (2004); and Takimoto et al., "Role of matrix and fusion proteins in budding of Sendai virus" *J. Virol.* 75: 11384-91 (2001). Similar to NDV M protein, the SV and hPIV1 M proteins were sufficient for particle release, the SV5 M protein, however, was not sufficient. SV5 M protein co-expression with NP and at least one glycoprotein was required for efficient formation and release of SV5 VLPs. Schmitt et al., "Requirements for budding of paramyxovirus simian virus virus-like particles" *J Virol* 76:3952-64 (2002).

In one embodiment, the present invention contemplates that only M protein, and no other paramyxovirus protein, can solely direct VLP particle release. Previous studies do indicate that SV F protein may exhibit an autonomous exocytosis activity demonstrated by the release of vesicles containing the only the F protein. Sugahara et al., "Paramyxovirus Sendai virus-like particle formation by expression of multiple viral proteins and acceleration of its release by C protein" *Virology* 325:1-10 (2004); and Takimoto et al., "Role of matrix and fusion proteins in budding of Sendai virus" *J. Virol.* 75: 11384-91 (2001).

In contrast, cells contemplated by the present invention expressing the NDV F protein, alone, did not release F protein-containing material, and cells expressing HN protein, alone, released only trace amounts of very light density material HN protein containing material into the cell supernatants. These observations are similar to other reports showing that expression of SV5 F or HN glycoproteins, alone, did not result in VLP particle release. Schmitt et al., "Requirements for budding of paramyxovirus simian virus virus-like particles" *J Virol* 76:3952-64 (2002). Although it is not necessary to understand the mechanism of an invention, it is believed that despite observations that SV F and other enveloped negative strand virus glycoproteins have been shown to exhibit budding activity, no Late Domains have been identified in any viral glycoproteins. Schmitt et al., "Escaping from the cell: assembly and budding of negative-strand RNA viruses" *Cuff Top Microbiol Immunol* 283:145-96 (2004).

Embodiments of the present invention comprising co-expression of M protein and NP is also in contrast with those reported in the SV system. For example, simultaneous expression of SV M and NP is known to result in the release of VLPs containing both viral proteins. Sugahara et al., "Paramyxovirus Sendai virus-like particle formation by expression of multiple viral proteins and acceleration of its release by C protein" *Virology* 325:1-10 (2004).

G. Protein-Protein Interactions

The present invention contemplates using NDV as a prototype paramyxovirus in order to clarify the role of each paramyxovirus protein in particle assembly and release. Using this model, certain embodiments integrate a definition of the viral protein requirements for assembly and release of VLPs with a characterization of the protein-protein interactions in VLPs formed with different combinations of viral proteins.

Further, in some embodiments the present invention contemplates a co-localization of M protein with the viral glycoproteins in plasma membranes. Although it is not necessary to understand the mechanism of an invention, it is believed that the data presented herein show that particle assembly involves a network of specific protein-protein interactions and likely correct targeting of proteins to specific cellular domains.

In one embodiment, the present invention contemplates, VLP protein interactions form with all combinations of three and four proteins (i.e., for example, when defined by co-immunoprecipitation). In another embodiment, cell surface HN and F proteins are co-localized with M protein when expressed in different combinations with M and NP proteins. In another embodiment, co-expression of two viral proteins with M protein also significantly increased the co-localization of M protein with either HN or F proteins in the plasma membrane indicating increased interactions with M protein.

To define these protein-protein interactions, VLPs formed with different combinations of three and four proteins were solubilized with nonionic detergent and proteins precipitated with cocktails of monospecific antibodies for M, HN, or F proteins. First, each antibody cocktail precipitated all proteins from VLPs formed with M, HN, F and NP, although the efficiency of precipitation for each protein varied with the antibody specificity. Although it is not necessary to understand the mechanism of an invention, it is believed that these results are consistent with a network of interactions between all four proteins such that precipitation of one resulted in the precipitation of the other three proteins but with efficiencies that varied determined by how directly a protein was linked to the precipitated protein.

Figure 66:
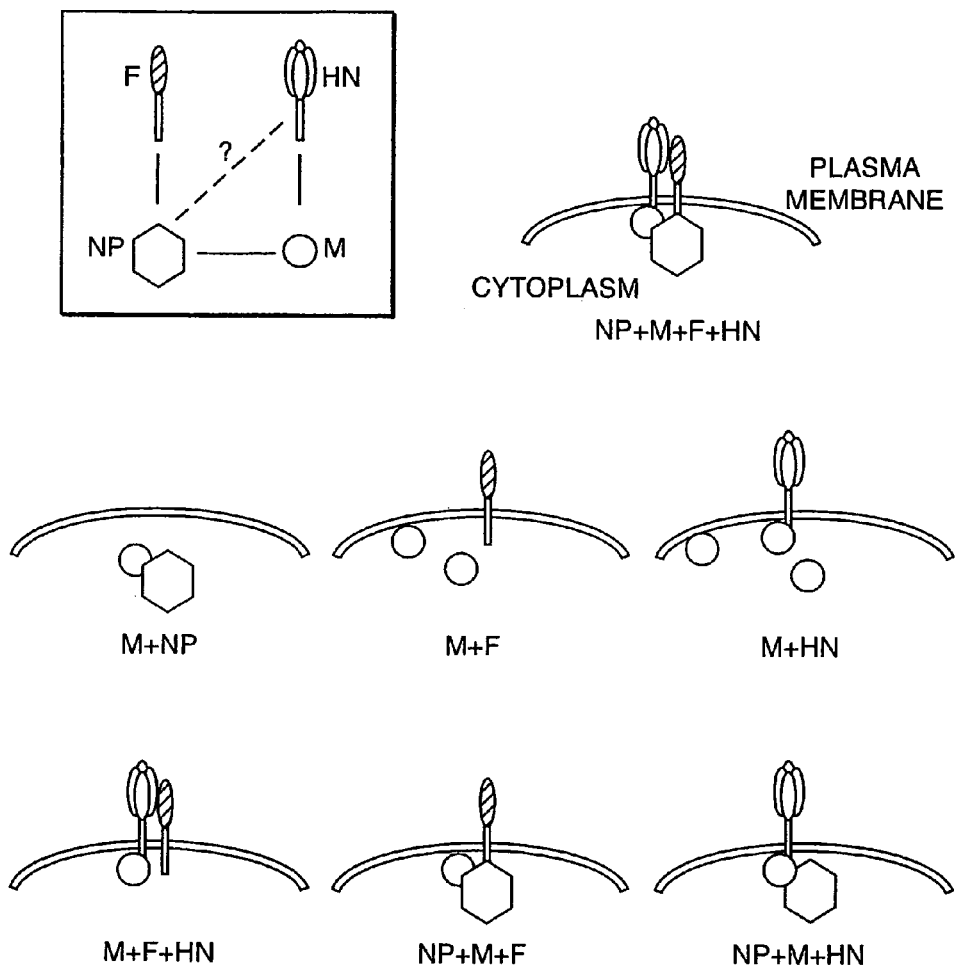
Figure 67A:
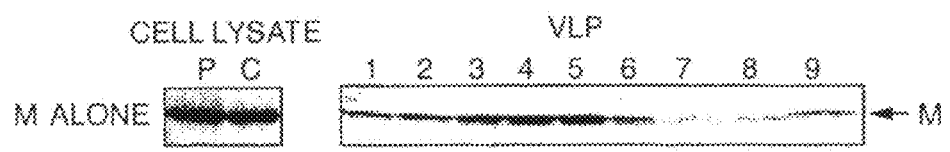
Figure 67B:
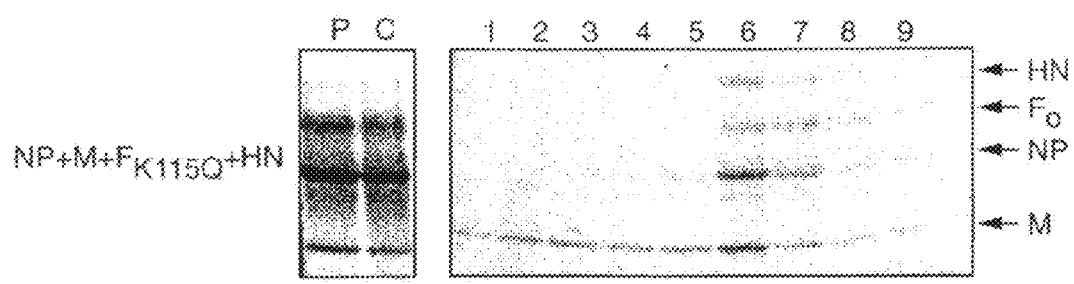
Figure 68A:
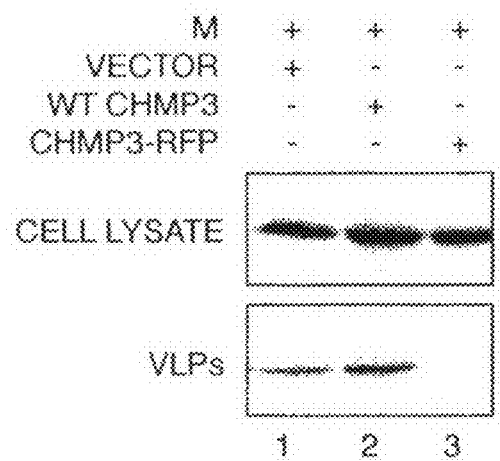
Figure 68B:
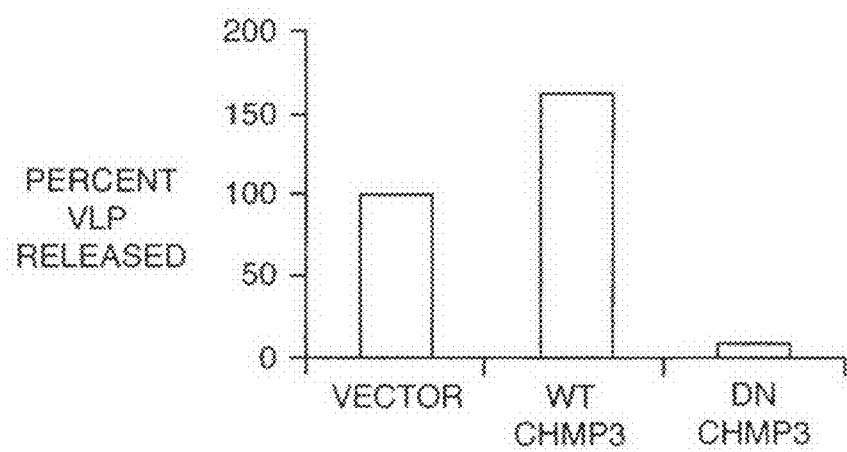
Figure 68C:
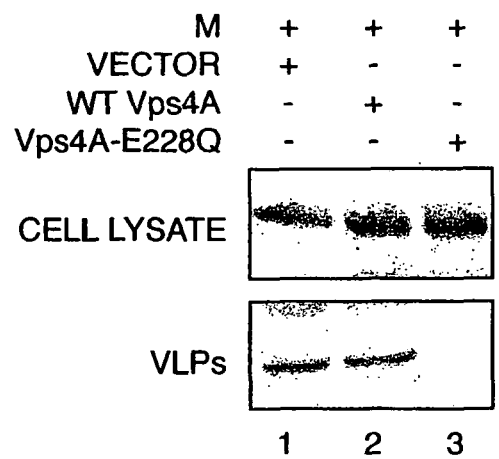
Figure 68D:
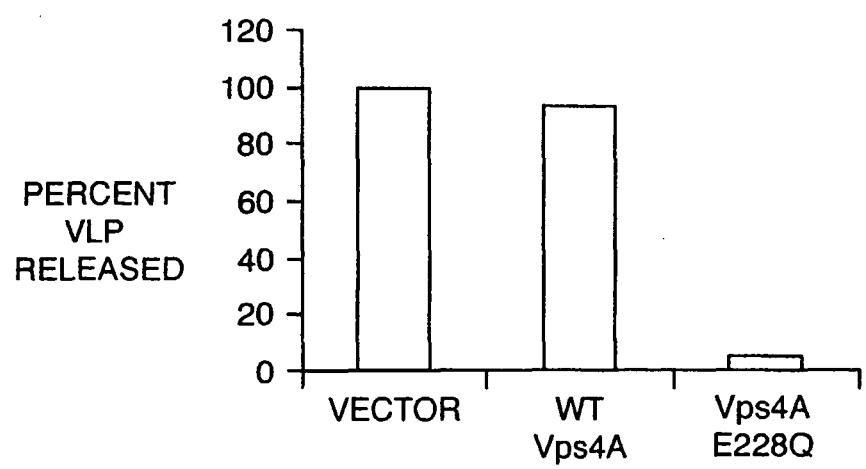
Figure 68E:
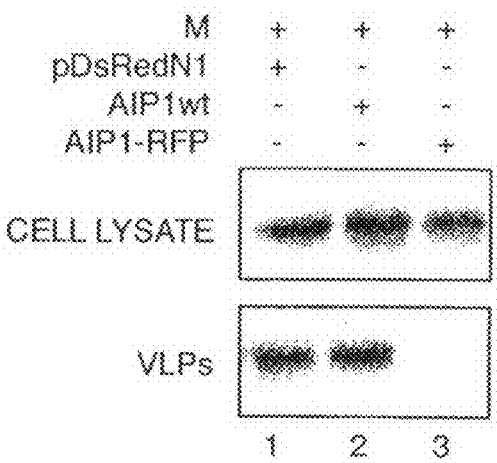
Figure 68F:
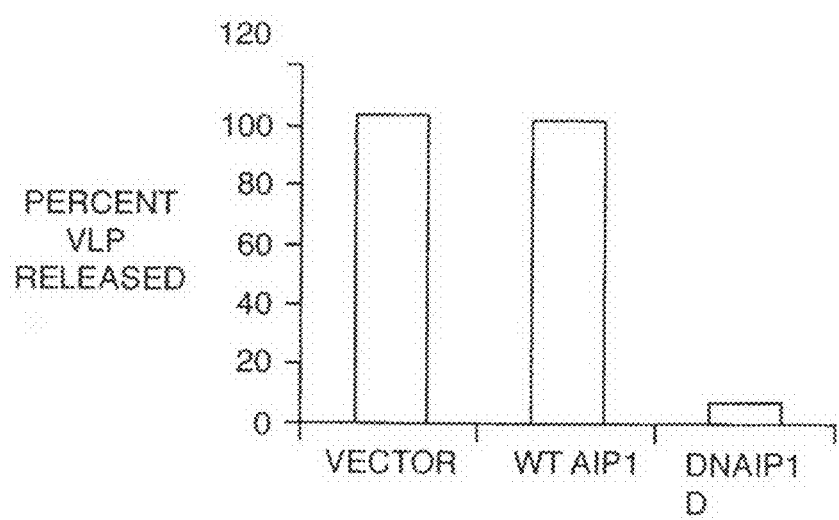
Figure 69A:
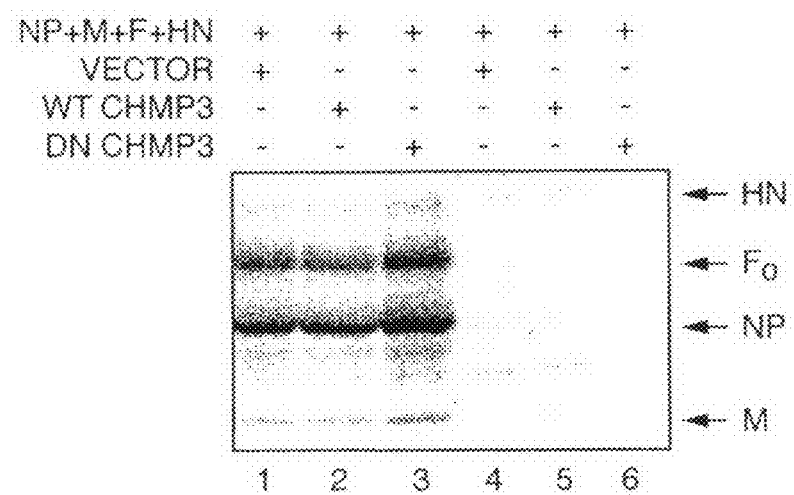
Figure 69B:
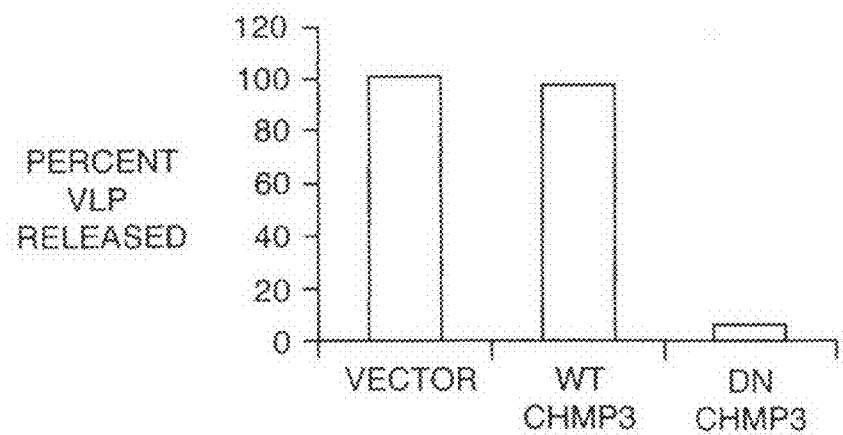
Figure 69C:
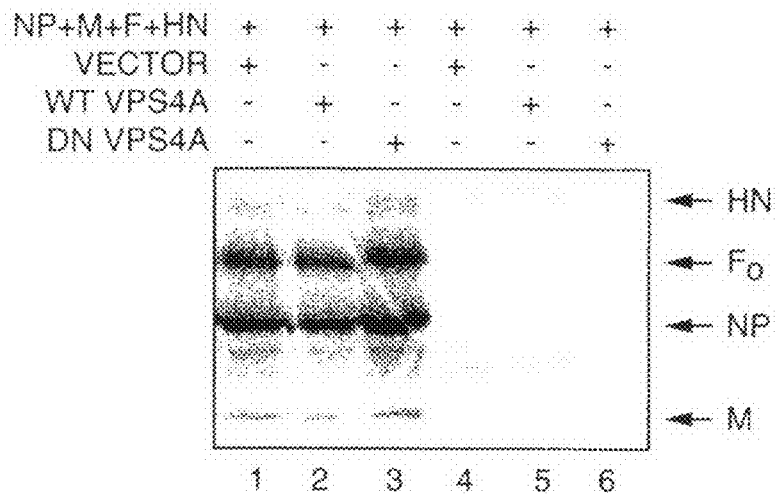
Figure 69D:
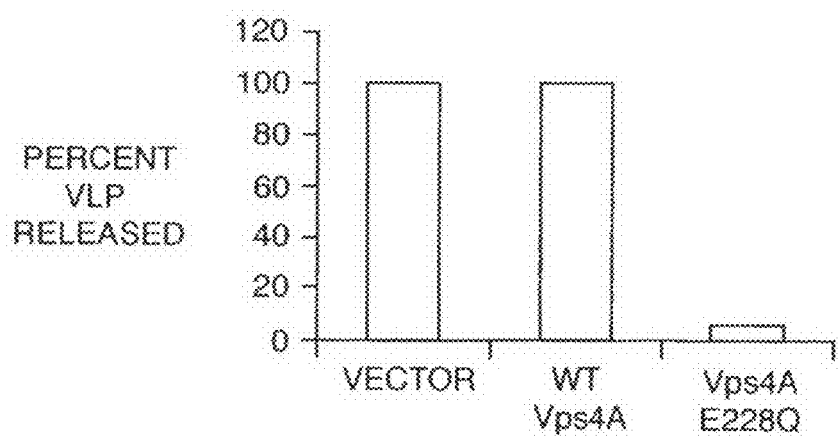
Figure 69E:
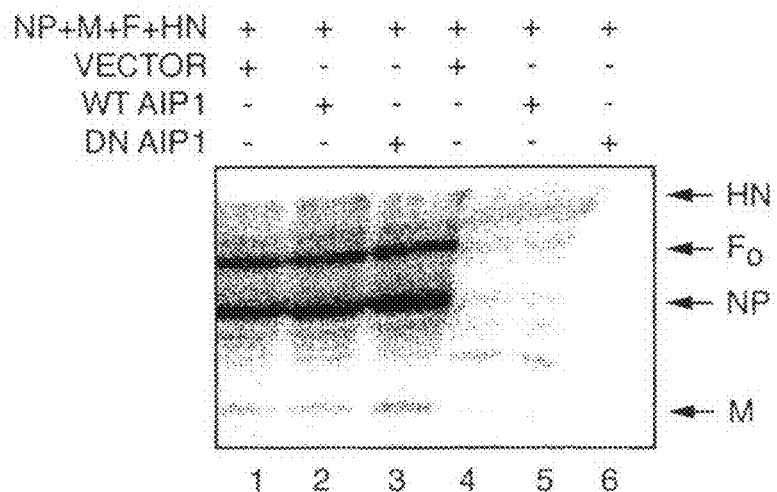
Figure 69F:
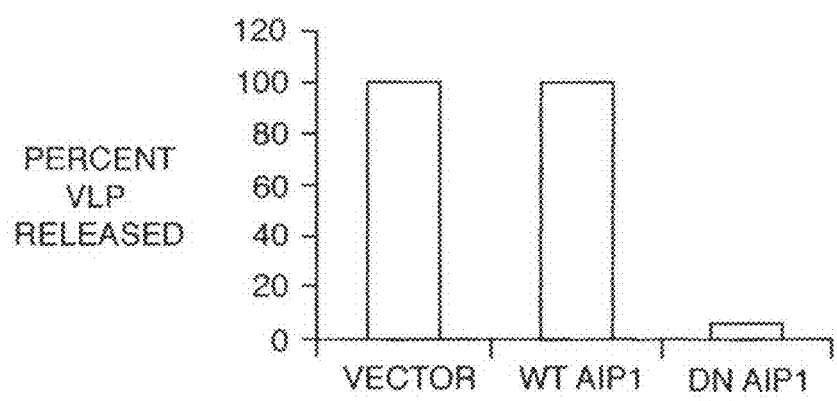
Figure 70B:
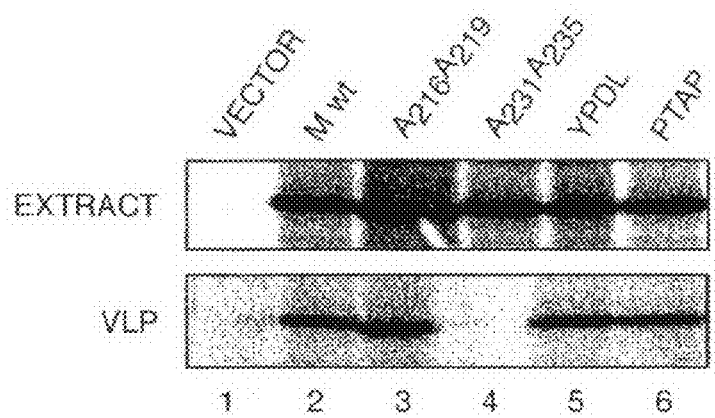
Figure 70C:
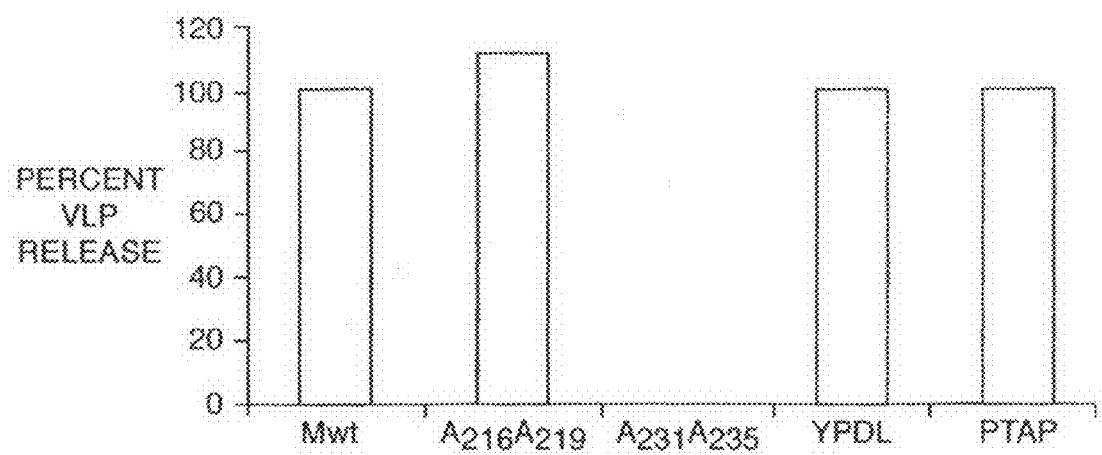
Figure 70D:
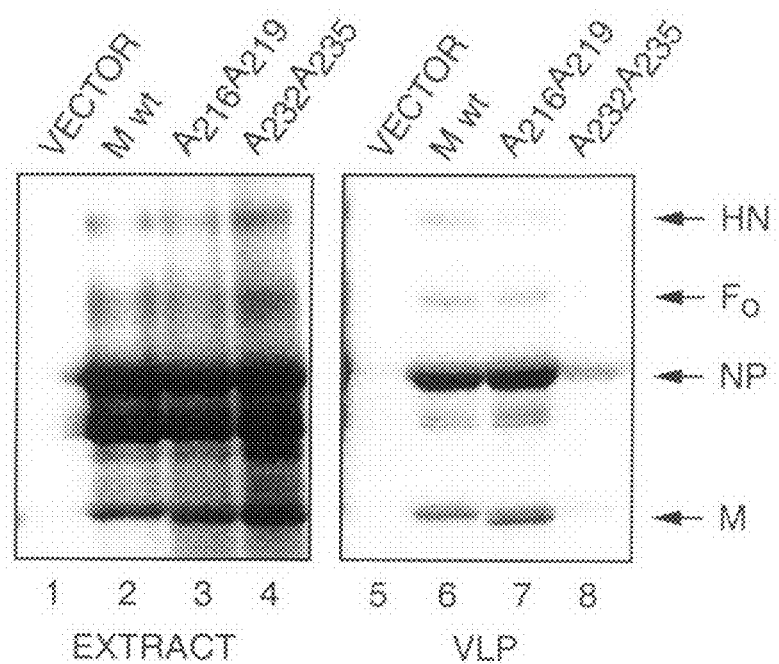
Figure 70E:
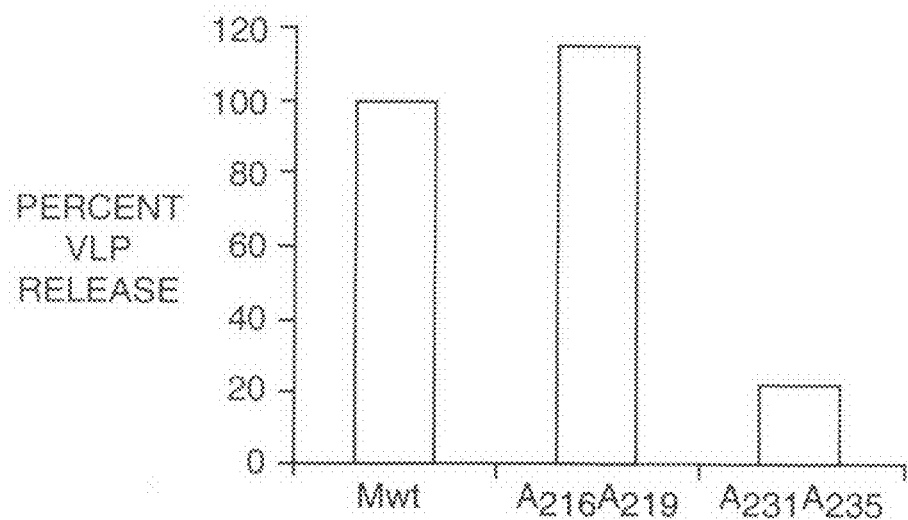

Protein-protein interactions were more clearly defined by immunoprecipitation of proteins from VLPs formed with all combinations of three proteins. These results show a specific interaction between HN and M proteins, between NP and M protein, and between F protein and NP. (See, FIG. 66). A direct interaction between F protein and M protein was not directly observed but there is likely a weak interaction between F and HN proteins, since anti-F protein antibodies precipitated HN protein from VLPs containing M, HN, and F proteins. The apparent inability for F and M proteins to interact suggest that incorporation of F protein into these VLPs may be mediated by interactions with an HN protein. Alternatively, an interaction between HN protein and NP may also facilitate incorporation processes.

Thus, when all four proteins are co-expressed, NP and HN protein are incorporated into VLPs by a direct interaction with M protein. (See, FIG. 66). Although it is not necessary to understand the mechanism of an invention, it is believed that F protein is likely incorporated indirectly due to interactions with NP and HN protein. It is further believed that an ordered complex of the four proteins is supported by a co-localization of M protein with F protein and M protein with HN protein in the plasma membrane when all four proteins are co-expressed.

However, when only F is expressed with M protein, F protein was likely not significantly incorporated into VLPs because a direct interaction between these two proteins was not observed. (See, FIG. 66). Supporting this conclusion is the observation that there was no co-localization of F and M proteins in the plasma membrane in these cells.

In spite of direct associations of M with NP, there was little NP protein incorporation into VLPs when NP and M proteins were co-expressed in the pair-wise combination. Previous reports that show that the M protein of Sendai virus is recruited in the cytoplasm by the viral nucleocapsid. Stricker et al., "The Sendai virus matrix protein appears to be recruited in the cytoplasm by the viral nucleocapsid to function in viral assembly and budding" *J Gen Virol* 75 (Pt 5):1031-1042 (1994). Perhaps NP causes the retargeting of M protein to this compartment. Indeed, co-expression of M protein with NP resulted in a 2.5 fold suppression of M protein containing VLP release, a result also consistent with retention of M protein in cells by NP protein.

Although co-immunoprecipitations of VLP proteins formed with M, HN, and F protein indicated a direct interaction of HN protein with M protein, there were only low levels of incorporation of HN protein into VLPs when HN and M proteins were co-expressed in a pair-wise combination. Furthermore, there was little co-localization of the two proteins in the plasma membrane. Perhaps, in the absence of other proteins, HN and M proteins show minimal co-localization in the same regions of the cell, thereby preventing their association. Alternatively, it is also possible that the conformation of the HN protein transmembrane or cytoplasmic tail may be different in the absence of expression of F protein or NP protein inhibiting association of HN protein with M protein. The 50% reduction of M protein VLPs upon co-expression of HN protein with M protein cannot be presently explained but similar results have been previously reported in Sendai virus system. Sugahara et al., "Paramyxovirus Sendai virus-like particle formation by expression of multiple viral proteins and acceleration of its release by C protein" *Virology* 325:1-10 (2004).

It should be realized that immunoprecipitation is not necessary to produce purified VLPs. In one embodiment, the present invention contemplates a VLP preparation comprising pure viral proteins. Protein compositions were compared between purified NDV whole virus and VLPs that have not undergone immunoprecipitation. The data show that the VLP preparation does not contain any proteins that are not present in the whole virus preparation. See, FIG. 72. Consequently, the VLPs are as pure as the whole virus.

Although it is not necessary to understand the mechanism of an invention, it is believed that VLPs formed with NP, M and F proteins are likely due to interactions between M and NP and interactions between F and NP. (See, FIG. 66). For example, F protein may relocate NP to the plasma membrane drawing M to specific domains containing F protein. Indeed, data presented herein show that addition of NP increases the co-localization of M protein with F protein in the plasma membrane. It is further believed that VLPs formed with NP, M and HN proteins likely form due to interactions of both HN protein and NP with M protein. Data presented herein show that expression of NP with HN and M proteins increase the co-localization of M and HN proteins in the plasma membrane. One possible hypothesis suggests that NP-M protein interactions alter the conformation of M thereby facilitating its interaction with HN protein. Indeed, surface HN protein in the presence of NP appears more punctuate along the cell edges.

This network of interactions proposed above could account for the conclusions that the cytoplasmic domains (CT) of the HN and F proteins have redundant functions. Schmitt et al., "Requirements for budding of paramyxovirus simian virus 5 virus-like particles" *J Virol* 76:3952-3964 (2002). For example, the CT domain of the F protein may target NP-M complexes to the plasma membrane by interactions with NP protein while the HN protein CT domain targets these complexes by virtue of direct interactions with M protein.

The interaction of M protein and NP suggested by the data herein is supported by studies using Sendai virus. Stricker et al., "The Sendai virus matrix protein appears to be recruited in the cytoplasm by the viral nucleocapsid to function in viral assembly and budding" *J Gen Virol* 75 (Pt 5):1031-1042 (1994). Further, a possible interaction of HN protein with other viral protein is consistent with numerous studies suggesting an interaction of M protein with viral glycoproteins in paramyxovirus-infected cells or in cells transfected with paramyxovirus cDNAs. Ali et al., "Assembly of Sendai virus: M protein interacts with F and HN proteins and with the cytoplasmic tail and transmembrane domain of F protein" *Virology* 276:289-303 (2000); Ghildyal et al., "Interaction between the respiratory syncytial virus G glycoprotein cytoplasmic domain and the matrix protein" *J Gen Virol* 86:1879-1884 (2005); Henderson et al., "Sorting of the respiratory syncytial virus matrix protein into detergent-resistant structures is dependent on cell-surface expression of the glycoproteins" *Virology* 300:244-254 (2002); Sanderson et al., "Sendai virus assembly: M protein binds to viral glycoproteins in transit through the secretory pathway" *J Virol* 67:651-663 (1993); and Yoshida et al., "Membrane (M) protein of HVJ (Sendai virus)—Its role in virus assembly" *Virology* 71:143-161 (1976). Indeed, it has been reported that the respiratory syncytial virus G protein specifically interacts with M protein. However, there are no previous reports of a direct interaction between F protein and NP. It is possible that interactions between viral proteins vary within paramyxoviruses and the requirements for formation of VLPs may depend upon the distribution of late domains on the viral proteins. The results presented herein are consistent with the proposal that the NDV M protein buds and releases indiscriminately from different cellular membranes in the absence of other viral proteins. Although it is not necessary to understand the mechanism of an invention, it is believed that when both glycoproteins and M proteins are present in the plasma membrane, the M protein-plasma membrane association has an improved stability. It is further believed that NP association with F and M protein may also further stabilize and organize the network of interactions within the assembling particle.

This protein-protein interacting network hypothesis has support from observations comparing electron micrographs of whole virus (B1) with VLPs formed only with M protein, and VLPs formed with NP, M, F, and HN proteins. See, FIG. 73. When all four viral proteins are present, the VLP size and shape is very similar to the whole virus. However, an M protein-only VLP size and shape is more hetergeneous when compare to the whole virus but is still remarkably similar.

In one embodiment, the present invention contemplates a VLP production system for NDV. In one embodiment, the M protein facilitates NDV VLP budding such that NDV VLP budding is virtually non-existent in the absence of M protein. In other embodiments, specific protein-protein interactions occur in VLPs involved in the ordered assembly of particles. In one embodiment, an interaction between M and HN or F and NP directs the targeting of M and NP into assembly sites within the plasma membrane.

III. Paramyxoviral Diseases

The present invention is not limited to NDV, measles, parainfluenza virus 3, and respiratory syncytial paramyxovirus diseases. Many other paramyxoviruses diseases are also within the scope of this invention. For example, both human diseases (See Table 1) and animal diseases (See Table 2) are contemplated.

TABLE 1

Paramyxovirus-Mediated Human Diseases Susceptible To VLP Vaccination

| Virus Type | Disease Type | Current Vaccination |
|---|---|---|
| Parainfluenza (1, 2, 3, and 4) | Acute Respiratory Infection | None |
| Mumps | Childhood Disease | Live Attenuated Virus |
| Measles | Childhood Disease | Live Attenuated Virus |
| Respiratory Syncytial | Serious Respiratory Infection | None |
| Nipah | Emerging Infection Acute Neurological Disease | None |
| Hendra | Emerging Infection Acute Neurological Disease | None |
| Metapneumovirus | Acute Respiratory Infection | None |

TABLE 2

Paramyxovirus-Mediated Animal Diseases Susceptible To VLP Vaccination

| Virus Type | Animal Species |
|---|---|
| Canine Distemper | Dogs |
| Rhinderpest | Cattle |
| Pneumoviruses | Birds |

A. Newcastle Disease

Newcastle disease virus (NDV) is an avian pathogen. There are different strains of this virus that have been isolated in many regions of the world. Some strains are avirulent and are used as live attenuated vaccines. Others are virulent and cause severe systemic disease in birds with a high mortality rate. Because of the threat to the poultry industry, the United States government has classified virulent NDV strains as select agents under the Patriots Act.

Most chickens in the United States are vaccinated with an avirulent NDV strain. The current vaccine, however, is not ideal. The vaccine, a live attenuated virus, infects chickens and causes a mild respiratory disease. As a result, vaccinated birds have a lower body weight and lower egg production than unvaccinated birds. For this reason, many other countries do not vaccinate against NDV. Thus, there are periodic outbreaks of the disease in these countries forcing massive bird slaughter to contain the disease. Flocks of vaccinated chickens can also be susceptible to some NDV virulent strains. Consequently, there have been Newcastle disease virus outbreaks in the United States. For example, there was an NDV outbreak in California in 2001-2002.

What is needed is a NDV vaccine that does not have negative productivity consequences and can induce a broader range of protection than currently used vaccines.

In birds, clinical evidence of NDV includes, but is not limited to, the respiratory, neurological and gastrointestinal systems. Clinical signs suggestive of Newcastle disease, are observed mainly in young birds. Common symptoms include, but are not limited to, inability to walk or fly, walking in circles, paralysis, twisted necks, depression, and high frequency of sudden death. In mammals, symptoms of Newcastle disease may include, but are not limited to, acute conjuctivitis.

A significant problem of the currently utilized NDV vaccines is a failure to protect against all NDV strains. Currently, inactivated NDV vaccines (i.e., attenuated) are sometimes used to vaccinate flocks of birds. While eliminating the detrimental effects of a live virus vaccination, these vaccines still have the disadvantage that they do not stimulate a broad spectrum of immune responses. Further, incomplete attenuation results in a percentage of vaccinated birds contracting Newcastle disease. These vaccines are also more expensive than embodiments contemplated by the present invention due to the increased manipulation required for inactivation and the monitoring of the effectiveness of inactivation.

Another problem with currently used vaccines, either live virus or inactivated virus, is that it is difficult to distinguish between birds that have been vaccinated and those that have been infected with a wild virus. The present invention contemplates antigens incorporated into a VLP preparation comprising a sequence tag. In one embodiment, the sequence tag may be detected in vivo, thereby identifying a vaccinated animal.

B. Measles

Measles is believed to be a childhood infection characterized by fever, cough, coryza (i.e., for example, an upper respiratory tract infection or inflammation), and often conjunctivitis followed by a maculopapular rash. It has been observed that the severity of the disease varies with the strain of the virus as well as the health status of the infected children. In most children, recovery is complete. However, there is a low incidence of neurological complications of varying severity. Furthermore, malnourishment or another underlying disease can significantly increase the severity of the disease. In addition, the infection is immunosuppressive resulting in increased susceptibility of the child to other life threatening infections, particularly in a third world setting.

The currently used vaccine is a live, attenuated virus that is effective in generating a protective immune response. However, the age of immunization is problematic. Vaccination too early results in a poor antibody response due to maternal antibody. Increasing the dose to overcome this effect results in immunosuppression and increased susceptibility to other potentially life threatening infections. Vaccination at a later age places the infant at a risk of acquiring the disease prior to immunization but after the maternal antibody level declines. Thus there is a need for a vaccine that will generate an effective immune response in the face of material antibody and, more importantly, a vaccine that will not be immunosuppressive at any dosage. In one embodiment, the present invention contemplates that VLPs are a candidate for such a vaccine.

Certain embodiments of the present invention provide virus-like particles (VLPs) as a safe, broad-spectrum, and effective vaccine to protect mammals from a measles virus. Additionally, these embodiments provide systems and protocols for the large-scale, economical production of a measles VLP vaccine (i.e., for example, to be useful as a vaccine, VLP production must be easy and economical).

The present invention contemplates conditions for the generation of VLPs of a measles virus strain. In another embodiment, the VLPs comprise the same major antigens as infectious virus (but, of course, lack the complete viral genome). In another embodiment, the VLPs comprise major antigens having the same ratios as infectious virus. In one embodiment, the major antigens are selected from the group comprising nucleocapsid protein, membrane/matrix protein, hemagglutinin protein, and fusion protein.

Other embodiments of the present invention provide antigens derived from many different measles strains that may be incorporated into a single VLP preparation. A significant problem of the currently utilized measles vaccines is a failure to protect against all measles strains.

Measles is thought to be a highly contagious viral illness having primary symptoms including, but not limited to, fever, cough, conjunctivitis (i.e., redness and irritation in membranes of the eyes), and spreading rash. The viral infection may be spread by contact with droplets from the nose, mouth, or throat of an infected person. The incubation period is 8 to 12 days before symptoms generally appear.

Immunity to the disease occurs after vaccination or active infection. Currently, vaccination is limited to attenuated live virus that has a significant risk of causing measles in the vaccinated subject. Further some believe that the Measles-Mumps-Rubella vaccine can cause autism. Before widespread immunization, measles was so common during childhood that the majority of the population had been infected by age 20. Measles cases dropped over the last several decades to virtually none in the U.S. and Canada because of widespread immunization, but rates are currently on the rise. Public fear, therefore, results in lower vaccination rates that can cause outbreaks of measles, mumps, and rubella—which can be serious. One advantage of one embodiment of the present invention is that a VLP non-replicating measles vaccine carries no risk of infection. The VLP vaccine is thus expected to generate a much higher compliance rate and subsequently the measles occurrence should drop dramatically.

In one embodiment, measles symptoms include, but are not limited to, sore throat, runny nose, cough, muscle pain, fever, bloodshot eyes, tiny white spots inside the mouth (called Koplik's spots), photophobia (light sensitivity), a rash appearing around the fifth day of the disease and lasting 4-7 days that usually starts on the head and spreads to other areas, progressing downward (the rash may be a maculopapular rash appearing as both macules (flat, discolored areas) and papules (solid, red, elevated areas) that later merge together (confluent)), further the rash may itch.

There is no specific treatment of measles, though some children may require supplementation with Vitamin A. Symptoms may be relieved with bed rest, acetaminophen, and humidified air. The probable outcome is excellent in uncomplicated cases. However, pneumonia or encephalitis are possible complications.

C. Respiratory Syncytial Virus

Respiratory syncytial virus (RSV) is believed to be the single most common cause of hospitalization for respiratory infection of infants and young children worldwide. Re-infection also commonly occurs. RSV attack rates for all infant populations is estimated between 100% and 83% and an estimated 50% of these experience two or more infections during the first two years of life (reviewed in Collins, et al, Respiratory Syncytial Virus, in Fields Virology, Ed. Knipe, D. and Howley, P. Lippincott Williams and Wilkins, 2001). RSV is also increasingly recognized as a serious pathogen for the elderly.

Currently, there is no vaccine available for this pathogen. Early trials with a formalin inactivated virus preparation had the disastrous effect of enhancing the severity of disease upon exposure to the live virus. In addition, protein subunit vaccines had a similar effect in experimental animals. It is speculated that proteins in an abnormal conformation, either induced by formalin treatment or by expression and purification of individual proteins, resulted in a loss of epitopes that stimulated a protective immune response. Animal studies suggested that immunopathology was due to immune cells (reviewed in Collins, et al, Respiratory Syncytial Virus, in Fields Virology, Ed. Knipe, D. and Howley, P. Lippincott Williams and Wilkins, 2001. VLPs formed with RSV proteins will likely incorporate viral proteins in their native conformation. These immunogens have the potential to stimulate a protective immune response and to avoid the adverse effects of unfolded proteins.

Certain embodiments of the present invention provide virus-like particles (VLPs) as a safe, broad-spectrum, and effective vaccine to protect mammals from Respiratory Syncytial Virus (RSV). Additionally, these embodiments provide systems and protocols for the large-scale, economical production of RSV VLP vaccines (i.e., for example, to be useful as a vaccine, VLP production must be easy and economical).

The present invention contemplates conditions for the efficient generation of VLPs of a virulent RSV strain. In another embodiment, the VLPs comprise the same major antigens as infectious virus. In another embodiment, the VLPs comprise major antigens having the same ratios as infectious virus. In one embodiment, the major antigens are selected from the group comprising nucleocapsid protein, membrane/matrix protein, G or attachment protein, and fusion protein.

Other embodiments of the present invention provide antigens derived from many different RSV strains that may be incorporated into a single VLP preparation. A significant problem of the currently utilized RSV vaccines is a failure to protect against all RSV strains.

Respiratory syncytial virus (RSV) is believed to be a very common virus that causes mild cold-like symptoms in adults and older healthy children. RSV may cause serious respiratory infections in young babies, especially those born prematurely, who have heart or lung disease, or who are immunocompromised.

RSV is believed to be the most common respiratory pathogen in infants and young children. Specifically, RSV is believe to infect nearly all infants by the age of two years. Seasonal outbreaks of acute respiratory illness occur each year, on a schedule that is somewhat predictable in each region. The season typically begins in the fall and runs into the spring.

RSV may be spread easily by physical contact including, but not limited to, touching, kissing, and shaking hands with an infected subject. Although it is not necessary to understand the mechanism of an invention, it is believed that RSV transmission is usually by contact with contaminated secretions, which may involve tiny droplets or objects that droplets have touched. RSV can live for half an hour or more on the skin surface. It is also believed that RSV can also live up to five hours on countertops and for several hours on used tissues, consequently, RSV often spreads very rapidly in crowded households and day care centers.

In one embodiment, the present invention contemplates a VLP RSV vaccine that prevents the development of infant and young adult diseases such as, but not limited to, pneumonia, bronchiolitis (inflammation of the small airways of the lungs), and tracheobronchitis (croup). In one embodiment, the present invention contemplates a VLP RSV vaccine that prevents the development of a mild respiratory illness in healthy adults and older children.

The lack of a safe and effective RSV vaccine poses a significant public safety and health risk. For example, it is believed that each year up to 125,000 infants are hospitalized due to severe RSV disease; and about 1-2% of these infants die. Further, infants that are: i) born prematurely; ii) suffering chronic lung disease; iii) immunocompromised; or iv) afflicted with certain forms of heart disease are at increased risk for severe RSV disease. Even adults who are exposed to tobacco smoke, attend daycare, live in crowded conditions, or have school-age siblings are also at higher risk of contracting RSV.

In one embodiment, the present invention contemplates RSV symptoms including, but not limited to, nasal congestion, nasal flaring, cough, rapid breathing (tachypnea), breathing difficulty or labored breathing, shortness of breath, cyanosis (bluish discoloration of skin caused by lack of oxygen), wheezing, fever, or croupy cough (often described as a "seal bark" cough). It should be recognized that symptoms are variable and differ with age. For example, infants less than one year old are most severely affected and often have the most trouble breathing. Conversely, older children usually have only mild, cold-like symptoms. In general, symptoms usually appear 4-6 days after exposure.

Because there is no known treatment for an active RSV infection, those in the art have considered preventative drugs. For example, Synagis® (palivizumab) has been approved for prevention of RSV disease in children younger than 24 months of age who are at high risk for serious RSV disease. Synagis® however, must be prescribed and given as a monthly shot to provide complete protection.

D. Parainfluenza 3 (PIV 3)

PIV3 is believed to be a common cause of respiratory disease (rhinitis, pharyngitis, laryngitis, bronchiolitis, and pneumonia). This virus is the second most common cause of respiratory infection in hospitalized pediatric patients. No vaccines are available for PIV 3. A number of different approaches to vaccination have been considered but none has resulted in a licensed vaccine. (reviewed in Chanock, et al, Parainfluenza Viruses, in Fields Virology, Ed. Knipe, D. and Howley, P. Lippincott Williams and Wilkins, 2001).

Physiologically, PIV 3 usually infects the upper and lower respiratory systems. Currently, five serotypes of Parainfluenza virus are known (1, 2, 3, 4a, and 4b), all of which are associated with causing disease. Children are believed highly susceptible to Parainfluenza and may be responsible for approximately 40 percent to 50 percent of all cases of croup, and 10 percent to 15 percent of bronchiolitis and bronchitis and some pneumonias. In the general population, the incidence of parainfluenza is unknown but suspected to be very high. Illness causing only a runny nose and cold-like symptoms may pass as a simple cold rather than parainfluenza. Risk factors include young age. By school age most children have been exposed to parainfluenza virus. Most adults have antibodies against parainfluenza although they can get repeat infections.

Laryngotracheobronchitis (i.e., for example, croup) is believed to be a common clinical manifestation of parainfluenza virus infection. Parainfluenza viruses are found uncommonly associated with other respiratory tract infections in children such as tracheobronchitis, bronchiolitis, and bronchopneumonia. Occasionally, a mild non-specific illness is seen after parainfluenza virus infection. Parainfluenza viruses produce disease throughout the year, but peak prevalence rates occur during wintertime outbreaks of respiratory tract infections, especially croup, in children throughout the temperate zones of the northern and southern hemispheres. Parainfluenza virus infections are primarily childhood diseases, the highest age-specific attack rates for croup occur in children below the age of 3 years. Serotype 3 infections occur earliest and most frequently, so that 50% of children in the US are infected during the first year of life and almost all by 6 years, as determined by seroepidemiological studies.

Parainfluenza viruses generally enters a host through the inhalation of infected droplet nuclei. Virus multiplication occurs throughout the tracheobronchial tree, inducing the production of mucus. The vocal cords of the larynx become grossly swollen, causing obstruction to the inflow of air, which is manifested by inspiratory stridor. In adults, the virus is usually limited to causing inflammation in the upper parts of the respiratory tract. In infants and young children, the bronchi, bronchioles and lungs are occasionally involved, which may reflect on the small size of the airways and the relative immunological immaturity. Viraemia is neither an essential nor a common phase of infection.

Typically, children may exhibit a croupy cough, inspiratory stridor, hoarse voice or cry and respiratory difficulty on inspiration, and are usually afebrile. About 80% of patients exhibit a cough and runny nose 1 to 3 days before the onset of the cough. Respiratory rhonchi are heard frequently throughout the lung fields. Radiological examination is usually normal. Occasionally the epiglottitis is grossly swollen and reddened. Severe airway obstruction may ensue, necessitating an emergency tracheotomy.

IV. VLP Vaccines

Paramyxovirus VLP vaccines are novel in the art. While virosome vaccines are known, these vaccines require disrupting a purified virus, extracting the genome, and reassembling particles with the viral proteins and lipids to form lipid particles containing viral proteins. This approach is very costly. Also, since the starting material is live virus, there is a danger of contaminating the vaccine with live virus. In addition, the resulting vaccine is likely not a broad-spectrum vaccine. Furthermore, the immune response to this vaccine cannot be distinguished from a virus infection.

Paramyxovirus VLPs are believed to be a highly effective type of subunit vaccine that mimics the overall virus structure without containing genetic material that results in host cell infection. For example, a virus-like particle may completely lack the DNA or RNA genome while maintaining the authentic conformation of viral capsid proteins. Consequently, the VLP is non-infectious. Further, a virus-like particle comprising viral capsid proteins may undergo spontaneous self-assembly similar to authentic viruses. It is known, however, that polyomavirus VLP preparations are among the least developed in the art. Noad et al., "Virus-like particles as immunogens" *Trends Microbiol* 11:438-444 (2003).

In one embodiment, the present invention contemplates a vaccine comprising a paramyxovirus VLP. In one embodiment, the paramyxovirus is selected from the group including, but not limited to, Newcastle disease, measles, parainfluenza virus 3, or respiratory syncytial virus. In one embodiment, the VLP comprises an M protein. In another embodiment, the VLP further comprises at least two glycoproteins. In one embodiment, the glycoproteins are selected from the group consisting of F protein and HN protein.

A. Newcastle Disease Virus

Certain embodiments of the present invention provide virus-like particles (VLPs) as a safe, broad-spectrum, and effective vaccine to protect poultry from Newcastle disease virus. Additionally, these embodiments provide systems and protocols for the large-scale, economical production of VLPs (i.e., for example, to be useful as a vaccine, VLP production must be easy and economical).

A silver stain comparision of whole virus (B1) grown in eggs are compared to VLPs grown in large scale tissue culture demonstrates that VLPs may be produced in microgram quantities (i.e., sufficient for immunogenicity testing in mice). See, FIG. 74. VLPs have been rapidly purified from large amounts of media to faciliate large scale VLP production techniques. See, Table 3.

TABLE 3

Large Scale VLP Preparations

| Particle | | ng/µl | total volume | Total protein (µg) |
|---|---|---|---|---|
| B1 virus | HN | 23.05 | 1 ml | 23.05 |
| | F | 11.09 | | 11.09 |
| | NP | 100.32 | | 100.09 |
| | M | 75.08 | | 75.08 |
| | | | | 209.54 total |
| VLP prep1 | HN | 177.35 | 1.1 ml | 195.08 |
| | F | 349.56 | | 384.52 |
| | NP | 140.19 | | 154.21 |
| | M | 72.02 | | 79.22 |
| | | | | 813.04 total |
| VLP prep2 | HN | 109.70 | 0.5 ml | 54.85 |
| | F | 85.42 | | 42.71 |
| | NP | 98.24 | | 49.71 |
| | M | 63.50 | | 31.75 |
| | | | | 178.43 total |
| VLP prep 3 | HN | 92.55 | 0.2 ml | 18.4 |
| | F | 53.54 | | 10.70 |
| | NP | 92.13 | | 18.26 |
| | M | 60.89 | | 12.18 |
| | | | | 59.54 total |

Preparation 1 was contaiminated with albumin, which co-migrates with F protein. Therefore, the amounts of F in Preparation I appear enhanced when compared to NP. This albumin contamination was successfully eliminated in Preparations 2 & 3

Although it is not necessary to understand the mechanism of an invention, it is believed that virus (B1) grown in eggs (as is standard in the art) are deficient in the HN and F glycoproteins (typical of avirulent (AV) virus particles), unlike the presently disclosed VLP production methods in which virus (AV) VLP comprise HN and F glycoproteins. In one embodiment, the present invention contemplates an improved vaccine comprising an NVD VLP comprising HN and F glycoproteins.

NDV subunit protein expression has been reported in the art. For example, electron microscopic examination of negatively stained extracellular fluids (ECF) from *Spodoptera frugiperda* cell cultures infected with a recombinant baculovirus expressing the Newcastle disease virus (NDV) haemagglutinin-neuraminidase (HN) revealed NDV-like envelopes which resembled the envelopes of authentic NDV. Immunogold staining with anti-NDV HN monoclonal antibodies demonstrated HN antigen in spikes on the NDV-like envelopes. The ECF from the recombinant-infected cultures also contained baculovirus particles which resembled standard baculovirus particles except that some showed polar protrusions of the envelope. Unlike the embodiments contemplated in the present invention, it was concluded that NDV HN, in the absence of the matrix protein (i.e., M protein), might be able to initiate and control the production of viral envelopes which are morphologically identical to those of authentic NDV. Nagy et al., "Synthesis of Newcastle disease virus (NDV)-like envelopes in insect cells infected with a recombinant baculovirus expressing the haemagglutinin-neuraminidase of NDV" *J Gen Virol.* 72:753-756 (1991).

In one embodiment, the present invention contemplates a method comprising a commercially usable NDV VLP vaccine. In one embodiment, producing a NDV VLP vaccine is economical and efficient. In another embodiment, immunization with an NDV VLP vaccine stimulates production of a broad spectrum of protective antibodies. In one embodiment, an avian cell line continuously expresses at least four NDV glycoproteins.

In one embodiment, the present invention contemplates a method producing NDV VLP vaccines in a transient expression system. In one embodiment, the system comprises avian cells transfected with nucleic acid (e.g., in plasmids, expression vectors, etc) encoding at least one NDV viral glycoprotein. In one embodiment, the system comprises an avian cell line with select viral genes as part of the avian cell chromosome, wherein the incorporated viral gene continually releases NDV VLP particles useful for vaccines. In one embodiment, the viral gene comprises a viral glycoprotein. In one embodiment, the viral glycoprotein is selected from the group comprising NP protein, M protein, F-K115Q protein, or HN protein.

In one embodiment, the present invention contemplates a method of generating VLPs comprising antigens for many different NDV strains of NDV. Although it is not necessary to understand the mechanism of an invention, it is believed that an integrated NDV vaccine confers a broader protection range than that generated by current vaccines. In one embodiment, the present invention contemplates an VLP vaccine expression system comprising a first cDNA encoding a first viral protein gene from a first strain; a second cDNA encoding a second viral protein gene from a second strain; and a third cDNA encoding a third viral protein gene from a third strain. In one embodiment, the first viral protein gene is selected from the group comprising HN protein, F protein, NP protein or M protein. In one embodiment, the first strain is selected from the group comprising strain Hertz, strain AV, or strain B1. In one embodiment, the second viral protein gene is selected from the group comprising HN protein, F protein, NP protein or M protein. In one embodiment, the second strain is selected from the group comprising strain Hertz, strain AV, or strain B1. In one embodiment, the third viral protein gene is selected from the group comprising HN protein, F protein, NP protein or M protein. In one embodiment, the third strain is selected from the group comprising strain Hertz, strain AV, or strain B1. In one embodiment, the present invention contemplates a method for detecting a viral protein gene incorporated into a VLP vaccine comprising contacting the viral protein gene with strain specific antibodies or incorporated sequence tags.

In one embodiment, the present invention contemplates a method comprising a baculovirus expression system producing NDV VLP vaccines. Although it is not necessary to understand the mechanism of an invention, it is believed that baculovirus expression systems are capable the highest levels of expression of a protein of all expression systems available. In one embodiment, a baculovirus expression system produces milligrams of VLP vaccine. In one embodiment, a baculovirus expression vector encodes an NDV VLP vaccine. In one embodiment, an insect cell is transfected with a baculovirus expression system encoding an NDV VLP vaccine. In one embodiment, a baculovirus vector comprises at least four NDV structural proteins. For a VLP to be a realistic vaccine candidate, it needs to be produced in a safe expression system that is amenable to large-scale production. An insect-ceil-based protein production system has many advantages for VLP production. The first is that large amounts of recombinant proteins can be produced in high-density cell culture conditions in eukaryotic cells, resulting in high recovery of correctly folded antigen. Second, as the insect cells used for vaccine production can be cultured without mammalian-cell-derived supplements, the risk of culturing opportunistic pathogens is minimized. Third, the baculovirus used for recombinant protein expression has a narrow host range that includes only a few species of *Lepidoptera*, and therefore represents no threat to vaccinated individuals. Fourth, baculovirus is easily inactivated by simple chemical treatment, and is localized mainly in the nucleus and culture media of insect cell preparations, whereas most VLPs are purified from cytoplasmic extracts. Finally, the baculovirus system can be scaled-up for large-scale vaccine production.

B. Measles

In one embodiment, the present invention contemplates a measles vaccine comprising a measles virus like particle, wherein said particle comprises a measles matrix protein. In one embodiment, the vaccine further comprises at least two measles glycoproteins.

The use of VLP vaccines have been proposed for the measles paramyxovirus virus, but only retrovirus HIV VLP production was demonstrated in yeast cells. Morikawa Y., "Virus-like micrograms and process of producing the same" United States Patent Application Publ. No. 20040009193 (2004). This proposed technique is limited to VLP expression in eukaryotic bacterial cells and does not suggest either baculovirus or mammalian cell culture techniques. Further, there is no showing that these eukaryotic VLP vaccines are, in fact, safe and effective. More importantly, Morikawa's VLP measles vaccines relies upon type IV budding as described by Garoff et al., supra. Some embodiments described herein clearly demonstrate that the ribonucleic acid core is not required for paramyxovirus budding; as Garoff et al. teaches.

Another approach suggested as useful for the development of a paramyxovirus measles vaccine involves gene therapy techniques by administering a DNA vaccine. Robinson et al., "Compositions and methods for generating an immune response" United States Patent Application Publ. No. 20040105871 (2004). This technique has been demonstrated by the stable transfection of a host genome with an expression cassette comprising an HIV DNA VLP vaccine. See also, Mazzara et al., "Self assembled, defective, nonself-propagating viral particles" U.S. Pat. No. 5,804,196 (1998)(herein incorporated by reference)

An alternative gene therapy approach suggests incorporating live attenuated measles virus into an expression vector to produce a vaccine, either in vivo or in vitro. VLPs, however, are not contemplated for measles virus vaccines. Herold J., "SARS-coronavirus virus-like particles and methods of use" United States Patent Application Publ. No. 20050002953 (2005).

C. Respiratory Syncytial Virus

In one embodiment, the present invention contemplates a respiratory syncytial virus vaccine comprising a respiratory syncytial virus like particle, wherein said particle comprises a respiratory syncytial virus matrix protein. In one embodiment, the vaccine further comprises at least two respiratory syncytial virus glycoproteins.

VLPs have been disclosed for the production and use of HIV-related vaccines. In passing, it is suggested that many other virus (i.e., respiratory syncytial virus and measles virus) might also be compatible with the disclosed technology. No detail, however, is presented to support these speculations. Barnett et al., Expression of HIV polypeptides and production of virus-like particles" U.S. Pat. No. 6,602,705 (2003).

It has also been suggested that it might be possible to produce respiratory syncytial virus VLP vaccines in a manner identical to Bluetongue VLPs comprising the VP3, VP7, VP2, and VP5 genes. Ermak et al., "Oral immunization with multiple particulate antigen delivery system" U.S. Pat. No. 5,690, 938 (1997)(herein incorporated by reference). Aside from this brief mention, Ermak does not provide any technical information regarding paramyxoviruses, and is limited to the Orbivirus genus (Reoviridae family).

In vivo mouse cytotoxic lymphocyte responses (i.e., an immunization response) are hypothesized to occur following exposure to recombinant HIV-1-IIIB gp 160 envelope glycoprotein complexed to microspheres and administered as a vaccine. Rock, K. L., "Compositions and methods for inducing cytotoxic T lymphocyte responses by immunization with protein antigens" U.S. Pat. No. 6,328,972 (2001). Rock suggests that VLPs having antigens to either respiratory syncytial virus or measles virus might also stimulate these cytotoxic lymphocytes to generate an immune response. There is, however, no discussion, of any technical details or expectations of success regarding this approach. In fact, Rock does not show any data relevant to VLP vaccines for any antigen.

D. Parainfluenza 3 Virus

In one embodiment, the present invention contemplates a parainfluenza 3 virus vaccine comprising a parainfluenza 3 virus like particle, wherein said particle comprises a parainfluenza 3 virus matrix protein. In one embodiment, the vaccine further comprises at least two parainfluenza 3 glycoproteins.

E. Enhancement of VLP Vaccines

Vaccine or treatment compositions of the invention may be administered parenterally, by injection, for example, either subcutaneously or intramuscularly. Additional formulations which are suitable for other modes of administration include suppositories, and in some cases, oral formulations or formulations suitable for distribution as aerosols. Oral formulations include such normally employed excipients as, for example, pharmaceutical grades of mannitol, lactose, starch magnesium stearate, sodium saccharine, cellulose, magnesium carbonate, and the like. These compositions take the form of solutions, suspensions, tablets, pills, capsules, sustained release formulations or powders and contain 10%-95% of active ingredient, preferably 25-70%.

In the case of the oral formulations, the manipulation of T-cell subsets employing adjuvants, antigen packaging, or the addition of individual cytokines to various formulation can result in improved oral vaccines with optimized immune responses.

1. Adjuvants

The present invention further contemplates immunization with or without adjuvant. In one embodiment, the present invention contemplates a co-administration of a paramxyovirus VLP vaccine and an adjuvant, wherein the resultant immune response is enhanced. If adjuvant is used, it is not intended that the present invention be limited to any particular type of adjuvant—or that the same adjuvant, once used, be used all the time. While the present invention contemplates all types of adjuvant, whether used separately or in combinations, the preferred use of adjuvant is the use of Complete Freund's Adjuvant followed sometime later with Incomplete Freund's Adjuvant. Another preferred use of adjuvant is the use of Gerbu adjuvant (GMDP; C.C. Biotech Corp.). The invention also contemplates the use of RIBI fowl adjuvant (MPL; RIBI Immunochemical Research, Inc.). Other adjuvants include, but are not limited to, potassium alum, aluminum phosphate, aluminum hydroxide, QS21 (Cambridge Biotech), Titer Max adjuvant (CytRx), or Quil A adjuvant.

2. Cytokines

In one embodiment, the present invention contemplates a co-administration of a paramxyovirus VLP vaccine and a cytokine, wherein the resultant immune response is enhanced. Although it is not necessary to understand the mechanism of an invention, it is believed that cytokines may modulate proliferation, growth, and differentiation of hematopoietic stem cells that ultimately produce vaccine related antibodies. In one embodiment, a cytokine may be selected from the group comprising interleukin-12 (IL-12), granulocyte-macrophage colony-stimulating factor (GM-CSF), interleukin-6 (IL-6), interleukin-18 (IL-18), alpha, beta, or gamma-interferon ($\alpha,\beta,\gamma$-IFN) or chemokines. Especially preferred cytokines include IL-12 and GM-CSF. The cytokines can be used in various combinations to fine-tune the response of an animal's immune system, including both antibody and cytotoxic T lymphocyte responses, to bring out the specific level of response needed to control or eliminate a paramyxovirus infection.

V. VLP Vaccine Expression Systems

In one embodiment, the present invention contemplates methods to produce VLP vaccines economically and at high production rates. In one embodiment, the present invention contemplates a method comprising transfecting a cell culture with a nucleic acid expression vector comprising a paramyxovirus VLP vaccine cassette. In one embodiment, the cell culture comprises avian cells (i.e., for example, ELL-0 cells). In one embodiment, the cell culture comprises a virus (i.e., for example, baculovirus).

Other cells that are useful for expression of the invention's vectors include, without limitation, avian cells, insect cells and mammalian cells. In one embodiment, the cells are in vitro.

In one embodiment the avian cell is an ELL-0 cell (East Lansing Strain of Chicken embryo fibroblast), such as that used in Examples 29-33 and 36-37. Insect cells are exemplified by *Trichoplusia ni* (Tn5) cells and SF9 cells. In a further embodiment, the mammalian cell may be a Chinese hamster ovary CHO-K1 cells (ATCC CC1-61), bovine mammary epithelial cells (ATCC CRL 10274), monkey kidney CV1 line transformed by SV40 (COS-7, ATCC CRL 1651), (293 or 293 cells subcloned for growth in suspension culture; see, e.g., Graham et al, J. Gen Virol., 36:59 (1977)), baby hamster kidney cells (BHK, ATCC CCL 10), mouse sertoli cells (TM4, Mather, Biol. Reprod. 23:243-251 (1980)), monkey kidney cells (CV1 ATCC CCL 70), African green monkey kidney cells (VERO-76, ATCC CRL-1587), human cervical carcinoma cells (HELA, ATCC CCL 2), canine kidney cells (MDCK, ATCC CCL 34), buffalo rat liver cells (BRL 3A, ATCC CRL 1442), human lung cells (W138, ATCC CCL 75), human liver cells (Hep G2, HB 8065), mouse mammary tumor cells (MMT 060562, ATCC CCL51); TR1 cells (Mather et al., Annals N.Y. Acad. Sci., 383:44-68 (1982)), MRC 5 cells, FS4 cells, rat fibroblast cells (208F), and MDBK cells (bovine kidney cells).

A. Avian Continuous Cell Culture Expression Systems

In one embodiment, the present invention contemplates a method comprising expressing paramyxoviral proteins using an avian cell culture (i.e., for example, ELL-0 cell culture). In one embodiment, the cell culture continuously expresses the proteins. In one embodiment, the paramyxoviral proteins are selected from the group including, but not limited to, Newcastle disease viral protein, measles virus proteins, parainfluenza virus 3, or respiratory syncytial virus proteins. In one embodiment, the paramyxoviral proteins are selected from the group including, but not limited to, matrix (M) proteins, nucleocapsid (NP) proteins, fusion (F) proteins, or heamagglutinin-neuraminidase (NM) proteins (and combinations thereof).

To generate avian cell lines expressing paramyxoviral proteins, it is useful to integrate the viral genes into an avian cell chromosome. The use of retrovirus vectors is a useful approach to accomplish this integration. Avian cells can be infected with a retrovirus containing a paramyxovirus gene and, as part of the retrovirus replication cycle, the retrovirus genome with the paramyxovirus gene will integrate into the cell chromosome. Four avian cell lines will be made: i) avian cells expressing M, NP, F, and HN proteins; ii) avian cells expressing M, NP, and F; iii) avian cells expressing M, NP, and HN proteins; and iv) avian cells expressing M, HN, and F proteins.

The retrovirus vector may be constructed such that the vector is unable to direct the formation of new, progeny retroviruses in the avian cells (i.e., non-replicability). The general approach for such studies is as follows. The paramyxovirus genes are cloned into a vector with the retrovirus ends (LTRs) and the packaging signal. This vector is, however, replication incompetent due to the lack of essential genes for that process (i.e., for example, gag or pol).

The vector DNA is transfected into a packaging cell line (i.e., for example, GP-293), a cell line expressing the retroviral structural proteins; gag, pol, and env. Also transfected with the vector is another DNA encoding the vesicular stomatitis virus (VSV) G protein (i.e., for example, pVSV-G). These cells then replicate retrovirus vectors and package the vector RNAs in an envelope with the env protein as well as the VSV-G protein (called a pseudotype). These cells release particles, which are then purified and used to infect avian cells. The presence of the VSV-G protein allows these particles to initiate infection in the avian cells and expands the host range of the retrovirus.

Following transfection, the vector RNA is converted to DNA, which is then integrated into the avian cell chromosome. Because the avian cells are not expressing gag or pol, the retrovirus infection does not proceed and no progeny virus are released. The transfected avian cells thus continuously express the integrated paramyxoviral genes, but not retrovirus genes.

This protocol will be repeated to sequentially integrate each of the four paramyxovirus proteins. Cell lines will be characterized for expression of the paramyxovirus genes and the release of VLPs from these cell lines will be verified.

Vectors and packaging cell lines (pantropic retrovirus expression system) to accomplish these steps are available from Clontech (BD Biosciences Clontech). In addition, there is available a vector (Q vector) which is engineered so that transcription of the target gene is driven by an internal promoter once the expression cassette is integrated into the avian cell genome. The Q vectors reduce the likelihood that cellular sequences located adjacent to the vector integration site will interfere with the expression of the paramyxovirus genes or that these sequences are abnormally expressed due to proximity with the retroviral LTR.

B. Baculovirus Expression Systems

Figure 29:
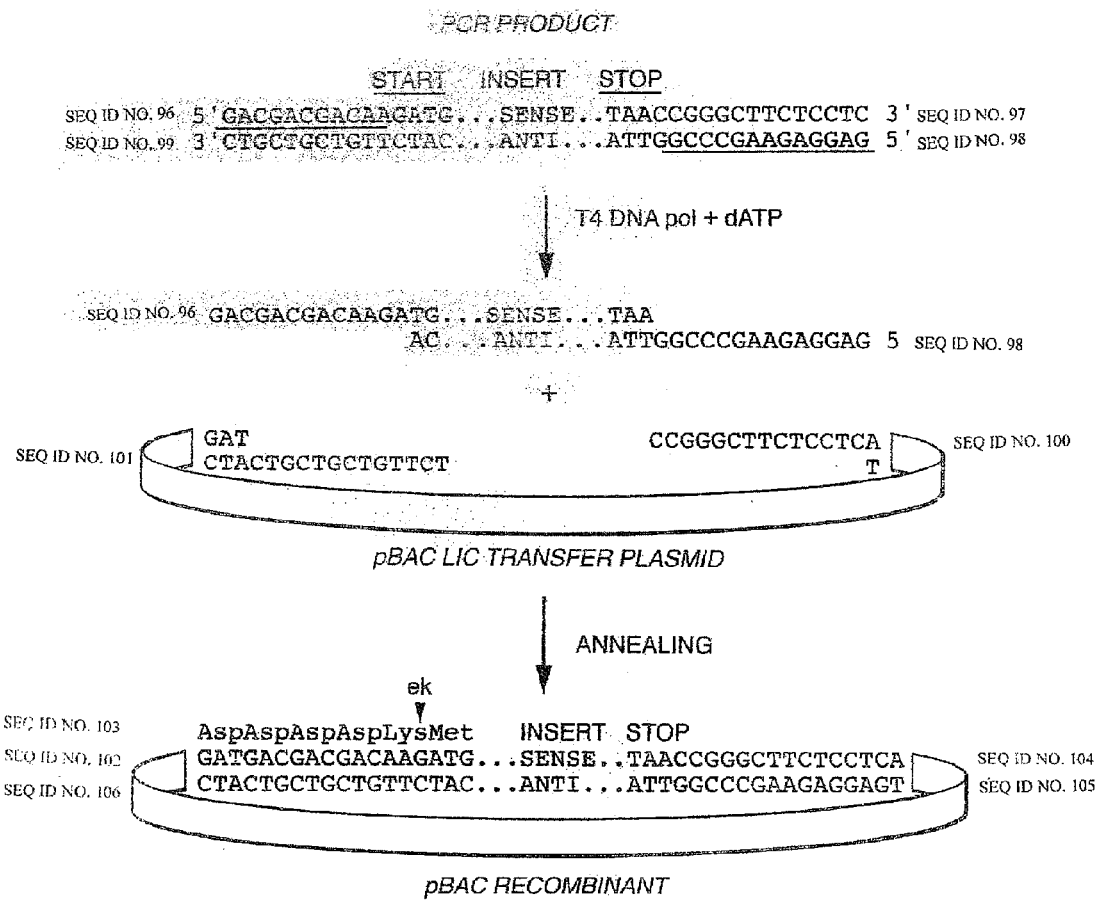
FIG. 29 (SEQ ID NOS:96-106) illustrates one ligation-independent cloning technique to produce a baculovirus recombinant DNA containing His-tag and S-tag sequence tags.
Figure 30:
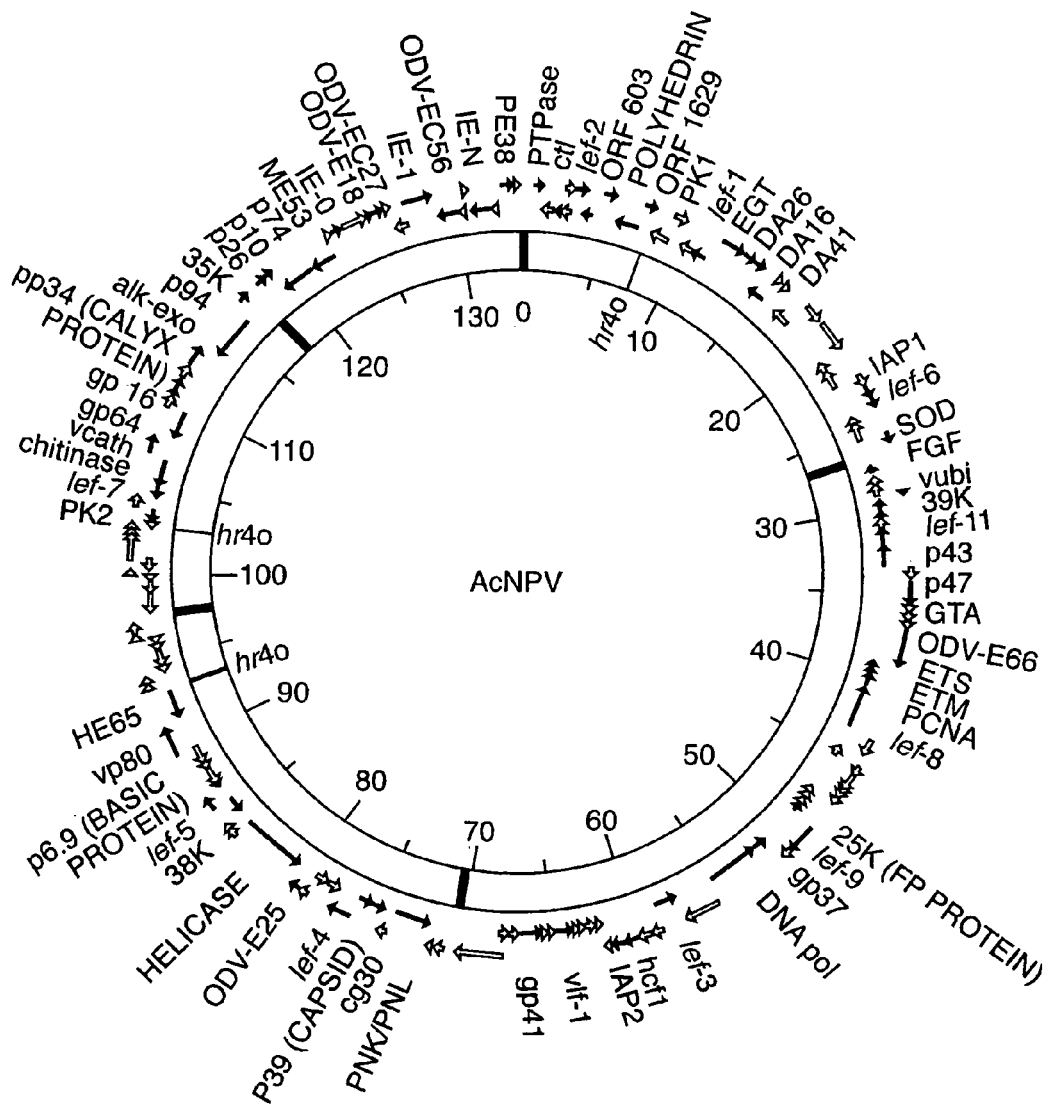
FIG. 30 depicts a circular map of a wild-type AcNPV C6 genome containing 154 putative open reading frames. Genes marked with solid arrows are known and reported in protein sequence databases. hr=AcNPV repetitive homologous region positions.

In one embodiment, the present invention may be practiced using the BacVector® system (Novagen). This system uses the baculovirus *Autographa californica* nuclear polyhedrosis virus (AcNPV) containing inserted genes to express proteins in an insect cell line (i.e., for example, Sf9). See FIG. 30. The present invention is not limited to one method of integrating target genes in to the AcNPV genome. Numerous different transfer plasmids may be used. For example, by co-transfecting cells with AcNPV DNA and the transfer plasmid, viruses can be isolated to have the genes inserted into the virus genome by homologous recombination (i.e., for example, using BacVector® Triple Cut Virus DNA, Novagen). See FIG. 28. In one embodiment, target genes (i.e., for example, NDV, measles, parainfluenza virus 3, or respiratory syncytial viral particle proteins) maybe cloned into a pBAC transfer plasmid to produce recombinant baculovirus vectors. In one embodiment, the recombination may comprise a ligation-independent cloning (LIC) technique. See FIG. 29. For example, a LIC transfer plasmid pBAC/pBACgus-2 cp may encode an upstream His-Tag and S-Tag peptide having an enterokinase (ek) cleavage site. The recombination is facilitated by primer sequences comprising: sense strand, 5' to ATG: GACGACGACAAG (SEQ ID NO:89); antisense strand, 5' to TTA: GAGGAGAAGCCCGG (SEQ ID NO:90).

Upon transfection, the BacVector® DNA will not produce virus unless there is a recombination event between the virus DNA and the transfer plasmid; i.e., a recombination that repairs the circular viral DNA required for replication. In one embodiment, the transfer plasmid comprises pBAC4x-1 (Novagen). See FIG. 31. Although it is not necessary to understand the mechanism of an invention, it is believed that pBAC4x-1 is constructed such that up to four (4) genes can be inserted into a single plasmid and, therefore, a single AcNPV. It is also believed that each gene is expressed using either the polh or the p10 promoters; promoters that can result in very high levels of protein expression from 24-72 hours post-infection. The pBAC4x-1 transfer vector was designed for expression of multi-subunit protein complexes and is capable of expressing the NDV M, NP, HN, and F genes either singly or in any combination.

Subsequent to co-transformation using a transfer plasmid and virus DNA, the infected cells (i.e., for example, Sf9) form plaques and express virus particles. These plaques are then isolated, wherein the expressed virus particles are purified and characterized for inserted protein gene expression. In one embodiment, the present invention contemplates an infected cell expressing virus particles comprising NDV, measles, parainfluenza virus 3, or respiratory syncytial protein genes, wherein the cell was transformed with baculovirus transfer plasmid. In one embodiment, the expression is characterized for optimal conditions, and times of expression, to support large-scale VLP preparation.

AcNPV-infected cells are known to produce extremely high quantities of the major very late gene products; polyhedrin (polh) and p10; 40-50% of the total cellular protein consists of these two gene products by the end of the infection cycle. Very late in infection (i.e., occurring after the budding and release phase), in both insects and in tissue culture, a large majority of the cell's transcriptional activity is dedicated to the polh and p10 promoters, which makes them ideal for use to drive the high-level expression of introduced target genes that replace these viral genes. Yields of up to 100 mg target protein per $10^9$ cells can be obtained.

The convenience of baculoviral expression systems has improved by developing viruses having Bsu36 I restriction sites positioned within an essential gene (i.e., for example, ORF 1629) downstream of the AcNPV polyhedrin gene and in the upstream ORF 603. such that digestion releases a fragment containing a sequence necessary for virus growth. Kitts et al., *BioTechniques* 14:810-817 (1993). When insect cells are co-transfected with an appropriate recombinant transfer plasmid and Bsu36 I-cut virus DNA, the necessary ORF 1629 sequence is supplied by the transfer plasmid through homologous recombination. The vast majority of the progeny viruses derived from these co-transfections contain the repaired virus with the target gene, thus minimizing the need to screen and multiply plaque purify recombinants. Alternatively, other baculoviral expression systems utilize other essential genes. For example, the progenitor BacVector-1000® and BacVector-2000® viruses from which the high efficiency BacVector-1000 and -2000 Triple Cut Virus DNAs® are prepared for cotransfections have the lacZ gene (β-galactosidase) in lieu of AcNPV polyhedrin gene. These lacZ-negative recombinants can be distinguished easily from any residual parental viruses, which are visualized as blue plaques when stained with X-Gal.

LacZ recombinants form clear plaques on staining with X-Gal, since the target gene replaces lacZ when the transfer plasmid recombines with the viral genome. A third Bsu36 I site within the lacZ gene further reduces the likelihood of reforming the parental virus. In practice and under optimal conditions, the commercially available baculovirus transfection technology produces plaques that are approximately >95% recombinant.

The recent elucidation of the complete sequence of the 133,894bp AcNPV genome has revealed a total of some 154 potential genes. See FIG. 30. A large number of these genes are unnecessary for growth of the virus in tissue culture. These non-essential genes are known to compete with target genes for cellular resources and can be deleterious to the expression of some gene products. It is preferable to use a baculovirus expression system wherein competing non-essential genes have been deleted.

Figure 31:
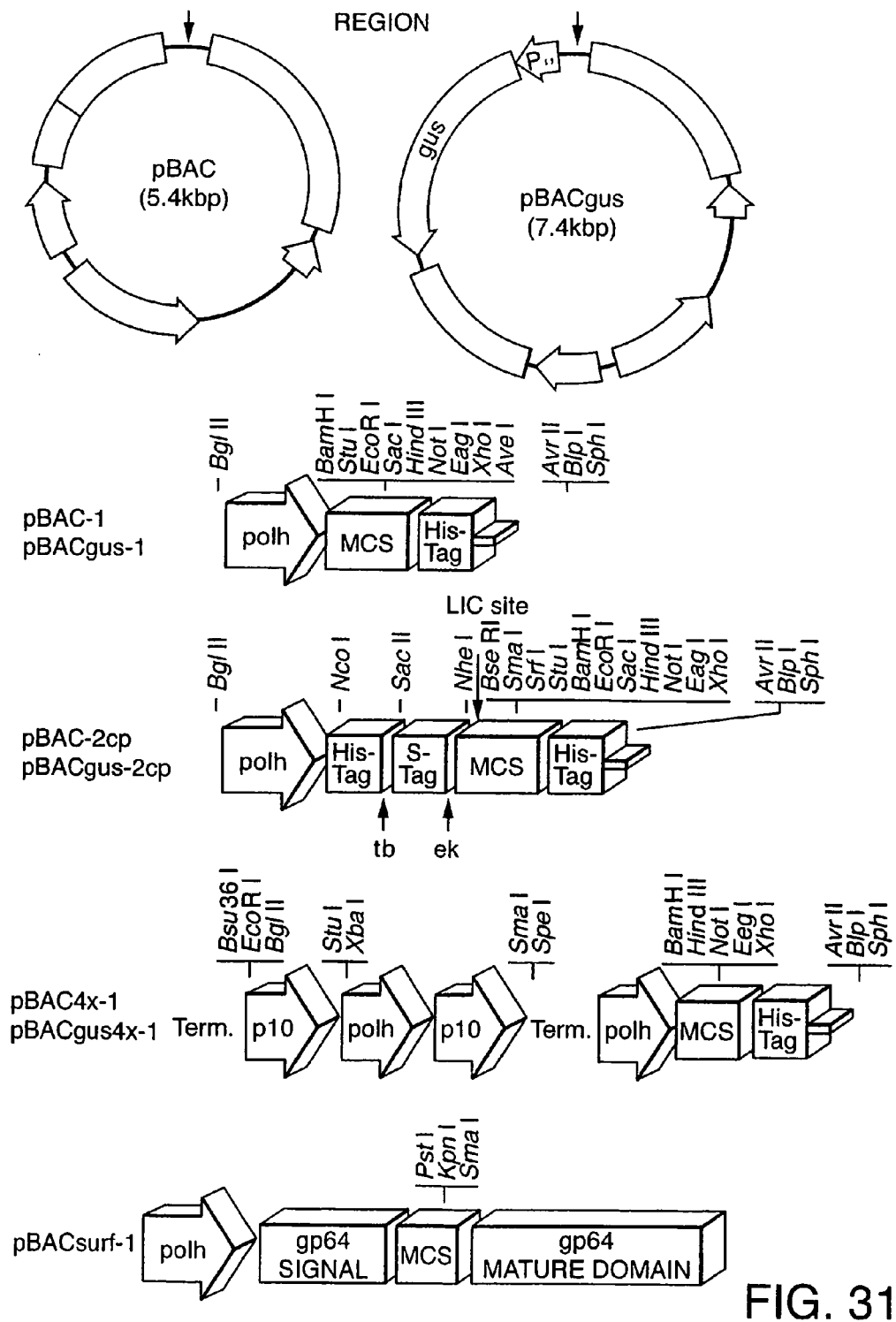
FIG. 31 illustrates seven (7) embodiments of a baculovirus transfer plasmid (pBAC).

In one embodiment, the present invention contemplates using pBAC transfer plasmids designed for the expression of target proteins (i.e., for example, NDV, measles, parainfluenza virus 3, or respiratory syncytial viral proteins). Several potential pBAC transfer plasmids are shown in FIG. 31. For example, two vector backbones (shown at the top) differ only by the presence of the reporter β-glucuronidase (gus) gene driven by the p6.9 promoter (i.e., for example, the pBACgus series). Because the gus gene and P6.9 are carried with the target gene into the baculovirus genome, recombinants produce β-glucuronidase and can be identified by staining with X-gluc. The corresponding transfer plasmids lacking the gus indicator gene are about 2 kbp smaller in size and may produce higher cloning efficiencies with some large inserts.

Additionally, LIC vectors including, but not limited to, pBAC-2cp and pBACgus-2cp plasmids are ready for annealing with appropriately prepared inserts. See FIG. 31. In practice, a target sequence is generated by PCR using primers extended with defined sequences. See FIG. 29. For example, vector compatible cohesive ends (13 and 14bp on the N- and C-terminal coding sequences, respectively) are produced by treatment with T4 DNA polymerase in the presence of dATP. The 3'-5' exonuclease activity of the enzyme digests one strand of the duplex until a dT residue is encountered in the complementary strand, whereupon the available dA is added by the polymerase activity. Aslanidis et al., *Nucleic Acids Res.* 18:6069-6074 (1990). The treated insert and pBAC LIC transfer plasmid are briefly annealed, and the mixture transformed into NovaBlue Competent Cells.

The prepared vectors allow fusion of target genes at the most desirable position relative to the enterokinase cleavage site following the His-Tag and S-Tag fusion sequences. Inserts may be placed such that vector-encoded sequences can be completely removed by enterokinase cleavage. See FIG. 29. In addition, the configuration of restriction sites in the multiple cloning region allows direct subcloning of inserts from many pET bacterial vectors into pBAC-1 or -2 series plasmids. The His-Tag sequence may be incorporated into, for example, the pBAC-1 or -2 vectors and encodes a consecutive stretch of 6 histidines. Alternatively, a S-Tag sequence encodes a 15 AA domain of ribonuclease A, which has a strong affinity for the 104 AA S-protein. Richards et al., *In: The Enzymes*, Vol. IV (Boyer, P. D., Ed.), pp. 647-806, Academic Press, New York (1971). This highly specific protein-protein interaction forms the basis for sensitive detection of fusion proteins with S-protein-reporter molecule conjugates. Chemiluminescent detection of S-Tag fusion proteins may be observed using an S-protein HRP conjugate and SuperSignal™ CL-HRP substrate. (S-Tag Rapid Assay Kit, Novagen).

The pBAC4x vectors are designed for coexpression of up to 4 genes in the same cell. These vectors are extremely useful for expression of multisubunit proteins, multiple copies of a gene, multiprotein complexes, and for studies of protein-protein interactions. Weyer et al., *J. Gen. Virol.* 72:2967-2974 (1991); Belyaev et al., *Nucleic Acids Res.* 21:1219-1223 (1993); and Belyaev et al., *Gene* 156:229-233 (1995).

It is known that baculoviral expression technology may be developed into an eukaryotic virus display system. Boublik et al., *Bio/Technology* 13:1079-1084 (1995). By appropriately engineering the AcNPV major surface glycoprotein (i.e., for example, gp64) functional proteins, including glycoproteins, can be expressed on the virus surface. A pBACsurf-1 transfer plasmid may be designed for in-frame insertion of target genes between the gp64 signal sequence and the mature protein coding sequence, under the control of the polh promoter. See FIG. 31. With this system, it is possible to construct and screen virus libraries of complex proteins for desired functional characteristics.

In one embodiment, the present invention contemplates using baculovirus expression technology to infect an Sf9 insect cell culture to express NDV, measles, parainfluenza virus 3, or respiratory syncytial viral proteins. These cells may be adapted for serum or serum-free monolayer, suspension, or fermentation culture, and ready for direct infection, transfection and plaque assay.

Extracts of wild-type AcNPV infected and uninfected Sf9 cells are useful for blocking non-specific binding of antibodies and other reagents to virus and insect cell proteins. The extracts are also useful for running as negative controls on Western blots, ELISA, binding assays, or enzymatic assays in which target proteins are analyzed in cell lysates.

In one embodiment, the present invention contemplates a VLP vaccine comprising proteins from different paramyxovirus strains. In one embodiment, the paramyxovirus strain is selected from the group including, but not limited to, Newcastle disease virus, measles virus, parainfluenza virus 3, or respiratory syncytial virus. In one embodiment, the NDV strain is virulent. In another embodiment, the virulent NDV strain may be selected from the group comprising strain AV and strain Hertz. In one embodiment, the NDV strain is avirulent. In another embodiment, the avirulent strain comprises strain B1.

In one embodiment, the present invention contemplates a composition comprising a cDNA clones encoding at least one paramyxovirus structural protein. In one embodiment, the structural protein comprises an HN glycoprotein. In one embodiment, the paramyxovirus is selected from the group including, but not limited to, Newcastle disease virus, measles virus, parainfluenza virus 3, or respiratory syncytial virus. In one embodiment, the clone is derived from a virulent NDV strain. In another embodiment, the virulent NDV strain may be selected from the group comprising strain AV and strain Hertz. In another embodiment, the clone is derived from an avirulent NDV strain. In one embodiment, the avirulent NDV strain comprises strain B1.

VI. VLP Vaccine Sequence Tags

In another embodiment, the present invention contemplates a paramyxovirus VLP vaccine such as, but not limited to, a Newcastle disease virus VLP vaccine, a measles virus VLP vaccine, a parainfluenza virus 3 VLP vaccine, or a respiratory syncytial virus VLP vaccine, wherein said vaccine comprises a sequence tag. In one embodiment, the vaccine is administered to a host. In one embodiment, the sequence tag is detected.

In one embodiment, the present invention contemplates a vector comprising at least one cDNA encoding a paramyxoviral protein, wherein said cDNA comprises a sequence tag. In one embodiment, the cDNA is transfected into a host cell. In one embodiment, the cDNA is incorporated into a host genome. In another embodiment, the cDNA resides in the host cytoplasm. In one embodiment, the sequence tag is detected.

A. Antibody Tags

The present invention contemplates some embodiments comprising a paramyxoviral glycoprotein expressed with a terminal sequence tag. In one embodiment, the tag comprises FLAG, HA and MYC tags.

In response to the rapidly growing field of proteomics, the use of recombinant proteins has increased greatly in recent years. Recombinant hybrids contain a polypeptide fusion partner, termed affinity tag (i.e., for example, a sequence tag), to facilitate the purification of the target polypeptides. The advantages of using fusion proteins to facilitate purification and detection of recombinant proteins are well-recognized. The present invention is compatible with various affinity sequence tags including, but not limited to, Arg-tag, calmodulin-binding peptide, cellulose-binding domain, DsbA, c-myc-tag, glutathione S-transferase, FLAG-tag, HAT-tag, His-tag, maltose-binding protein, NusA, S-tag, SBP-tag, Strep-tag, and thioredoxin. Terpe K., "Overview of tag protein fusions: from molecular and biochemical fundamentals to commercial systems" *Appl Microbiol Biotechnol.* 60:523-33 (2003).

FLAG, HA, and MYC are short amino acid sequences for which there are commercially available antibodies (i.e., for example, ELISA kits). In one embodiment, a F protein comprises a terminal FLAG tag. In one embodiment, the terminal comprises the C-terminal. In another embodiment, the terminal comprises the N-terminal. Although it is not necessary to understand the mechanism of an invention, it is believed that F or HN viral proteins comprising a terminal sequence tag (i.e., for example, FLAG or HA) are completely functional. It is further believed that when an F protein (or any other viral protein) comprising a terminal tag is incorporated into a VLP, immunized animals will make antibodies not only to the F protein, but also to the terminal tag (i.e., for example, a FLAG amino acid sequence).

Antibodies specific for sequence tags have affinities for specific protein sequences, known as an epitopes. An epitope has the property that it selectively interacts with molecules and/or materials containing acceptor groups. The present invention is compatible with many epitope sequences reported in the literature including, but not limited to, His X6 (HHHHHH) (SEQ ID NO:91) (ClonTech), C-myc (-EQKLI-SEEDL) (SEQ ID NO:92) (Roche-BM), FLAG (DYKD-DDDK) (SEQ ID NO:93) (Stratagene), SteptTag (WSH-PQFEK) (SEQ ID NO:94) (Sigma-Genosys), and HA Tag (YPYDVPDYA) (SEQ ID NO:95) (Roche-BM).

The FLAG peptide (Asp-Tyr-Lys-Asp-Asp-Asp-Asp-Lys) (SEQ ID NO:93) has been used as an epitope tag in a variety of cell types. For example, the modification of the cytomegalovirus (CMV) promoter containing vector, pCMV5, created two transient expression vectors designed for secretion and intracellular expression of FLAG-fusion proteins in mammalian cells. As a functional test, the bacterial alkaline phosphatase gene was cloned into both vectors, and anti-FLAG monoclonal antibodies were used for detection of FLAG epitope-tagged bacterial alkaline phosphatase in mammalian cells. In addition, secreted bacterial alkaline phosphatase was purified from the extracellular medium by anti-FLAG affinity chromatography. Chubet et al., "Vectors for expression and secretion of FLAG epitope-tagged proteins in mammalian cells" *Biotechniques* 20:136-41 (1996).

The net negatively charged HA-tag sequence (Tyr-Pro-Tyr-Asp-Val-Pro-Asp-Tyr-Ala) (SEQ ID NO:95) from the hemagglutinin influenza virus has proven useful in tagging proteins related to a wide variety of proteomic applications. In one embodiment, embodiment the present invention contemplates an improved HA epitope tag. Although it is not necessary to understand the mechanism of an invention, it is believed that the ability to metabolically label proteins with $^{35}$S-methionine facilitates the analysis of protein synthesis and turnover. However, efficient labeling of proteins in vivo is often limited by a low number of available methionine residues, or by deleterious side-effects associated with protein overexpression. To overcome these limitations, a methionine-rich variant of the widely used HA tag, called HAM, maybe useful with ectopically expressed proteins. In one embodiment, the present invention contemplates the development of a series of vectors, and corresponding antisera, for the expression and detection of HAM-tagged VLP viral proteins. These HAM tags improve the sensitivity of $^{35}$S-methionine labeling and permit the analysis of Myc oncoprotein turnover even when HAM-tagged Myc is expressed at levels comparable to that of the endogenous protein. Because of the improved sensitivity provided by the HAM tag, the vectors described herein should be useful for the detection of radiolabeled VLP proteins. Herbst et al., "HAM: a new epitope-tag for in vivo protein labeling" *Mol Biol Rep.* 27:203-8 (2000).

Alternatively, antibodies may be generated to recognize specific sequences within a protein or oligonucleotide. Such antibodies may be polyclonal or monoclonal. For example, specific sequences to a carcinoembryonic antigen may be detectable by antibodies. Barnett et al., "Antibody preparations specifically binding to unique determinants of CEA antigens or fragments thereof and use of the antibody preparations in immunoassays" U.S. Pat. No. 6,013,772 (2000) (herein incorporated by reference). Similarly, antibodies may be raised to specific nucleotide sequences. Tchen et al., "Probe containing a modified nucleic acid recognizable by specific antibodies and use of this probe to detect and characterize a homologous DNA sequence" U.S. Pat. No. 5,098,825 (1992)(herein incorporated by reference).

Numerous immunoassays may be used according to the present invention. The readout systems capable of being employed in these assays are numerous and non-limiting examples of such systems include fluorescent and colorimetric enzyme systems, radioisotopic labeling and detection and chemiluminescent systems. For example, an antibody preparation having a sequence-specific affinity for a sequence-tagged NDV viral protein (preferably a VLP particle protein) is attached to a solid phase (i.e., for example, a microtiter plate or latex beads). This antibody-VLP protein complex is then washed to remove unbound VLP particle proteins. After washing, color or fluorescence is developed by adding a chromogenic or fluorogenic substrate to activate the VLP protein sequence tag. The amount of color or fluorescence developed is proportional to the amount of VLP protein in the sample.

B. Chemical Tags

Sequence tags (i.e., nucleotide and/or protein sequences) also include molecules which will be recognized by the enzymes of the transcription and/or translation process without steric or electrostatic interference. Detection of sequence tags may occur through release of a label. Such labels may include, but are not limited to one or more of any of dyes, radiolabels, binding moieties such as biotin, mass tags, such as metal ions or chemical groups, charge tags, such as polyamines or charged dyes, haptens such as digoxygenin, luminogenic, phosphorescent or fluorogenic moieties, and fluorescent dyes, either alone or in combination with moieties that can suppress or shift emission spectra, such as by fluorescence resonance energy transfer (FRET) or collisional fluorescence energy transfer. Aizenstein et al., "Methods and compositions for detecting target sequences" U.S. Pat. No. 6,913,881 (2005)(herein incorporated by reference).

When TdT or polyA polymerase is employed, an oligonucleotide may contain a 5' end label. The invention is not limited by the nature of the 5' end label; a wide variety of suitable 5' end labels are known to the art and include biotin, fluorescein, tetrachlorofluorescein, hexachlorofluorescein, Cy$_3$ amidite, Cy$_5$ amidite and digoxigenin. A radioisotope label (e.g., a 32P or 35S-labelled nucleotide) may be placed at either the 5' or 3' end of the oligonucleotide or alternatively, distributed throughout the oligonucleotide (i.e., a uniformly labeled oligonucleotide). A biotinylated oligonucleotide may be detected by probing with a streptavidin molecule that is coupled to an indicator (e.g., alkaline phosphatase or a fluorophore) or a hapten such as dioxigenin and may be detected using a specific antibody coupled to a similar indicator. The reactive group may also be a specific configuration or sequence of nucleotides that can bind or otherwise interact with a secondary agent, such as another nucleic acid, and enzyme, or an antibody.

To be useful, sequence tags must possess certain physical and physio-chemical properties. First, a sequence tag must be suitable for incorporation into either a growing peptide chain or oligonucleotide. This may be determined by the presence of chemical groups which will participate in peptide or phosphodiester bond formation. Second, sequence tags should be attachable to a tRNA molecule or a nucleic acid polymerase complex. Third, sequence tags should have one or more physical properties that facilitate detection and possibly isolation of nascent proteins or oligonucleotides. Useful physical properties include a characteristic electromagnetic spectral property such as emission or absorbance, magnetism, electron spin resonance, electrical capacitance, dielectric constant or electrical conductivity.

Useful sequence tags comprise native amino acids coupled with a detectable label, detectable non-native amino acids, detectable amino acid analogs and detectable amino acid derivatives. Labels and other detectable moieties may be ferromagnetic, paramagnetic, diamagnetic, luminescent, electrochemiluminescent, fluorescent, phosphorescent, chromatic or have a distinctive mass. Fluorescent moieties which are useful as sequence tags include dansyl fluorophores, coumarins and coumarin derivatives, fluorescent acridinium moieties and benzopyrene based fluorophores. Preferably, the fluorescent marker has a high quantum yield of fluorescence at a wavelength different from native amino acids and more preferably has high quantum yield of fluorescence can be excited in both the UV and visible portion of the spectrum. Upon excitation at a preselected wavelength, the marker is detectable at low concentrations either visually or using conventional fluorescence detection methods. Electrochemiluminescent markers such as ruthenium chelates and its derivatives or nitroxide amino acids and their derivatives are preferred when extreme sensitivity is desired. DiCesare et al., *BioTechniques* 15:152-59 (1993). These sequence tags are detectable at the femtomolar ranges and below.

In addition to fluorescence, properties based on the interaction and response of a sequence tag to electromagnetic fields, radiation, light absorption (i.e., for example, UV, visible and infrared), resonance Raman spectroscopy, electron spin resonance activity, nuclear magnetic resonances, and mass spectrometry. Electromagnetic spectroscopic properties of a sequence tag are preferably not possessed by a naturally occurring compound and, therefore, are readily distinguishable. For example, the amino acid tryptophan absorbs near 290 nm, and has fluorescent emission near 340 nm. Thus, tryptophan analogs with absorption and/or fluorescence properties that are sufficiently different from tryptophan can be used to facilitate their detection in proteins.

For example, many different modified amino acids which can be used as sequence tags are commercially available (Sigma Chemical; St. Louis, Mo.; Molecular Probes; Eugene, Oreg.). One such sequence tag is N-ε-dansyllysine and may created by the misaminoacylation of a dansyl fluorophore to a tRNA molecule. Another such sequence tag is a fluorescent amino acid analog based on the highly fluorescent molecule coumarin. This fluorophore has a much higher fluorescence quantum yield than dansyl chloride and can facilitate detection of much lower levels. Rothschild et al., "Methods for the detection, analysis and isolation of nascent proteins" U.S. Pat. No. 6,875,592 (2005)(herein incorporated by reference).

Sequence tags for a protein can be chemically synthesized from a native amino acid and a molecule with marker properties which cannot normally function as an amino acid. For example a highly fluorescent molecule can be chemically linked to a native amino acid group. The chemical modification can occur on the amino acid side-chain, leaving the carboxyl and amino functionalities free to participate in a polypeptide bond formation. For example, a highly fluorescent dansyl chloride can be linked to the nucleophilic side chains of a variety of amino acids including lysine, arginine, tyrosine, cysteine, histidine, etc., mainly as a sulfonamide for amino groups or sulfate bonds to yield fluorescent derivatives. Such derivatization leaves the ability to form peptide bond intact, allowing the normal incorporation of dansyllysine into a protein.

In one embodiment, the present invention contemplates a fluorophore comprising a dipyrromethenebroron difluoride (BODIPY) derivative. The core structure of all BODIPY fluorophores is 4,4-difluoro-4-bora-3a,4a-diaza-s-indacene. See U.S. Pat. Nos. 4,774,339; 5,187,288; 5,248,782; 5,274,113; 5,433,896; 5,451,663 (all hereby incorporated by reference). All BODIPY fluorophores have a high extinction coefficient, high fluorescence quantum yield, spectra that are insensitive to solvent polarity and pH, narrow emission bandwidth resulting in a higher peak intensity compared to other dyes such as fluorescein, absence of ionic charge and enhanced photostability compared to fluorescein. The addition of substituents to the basic BODIPY structure which cause additional conjugation can be used to shift the wavelength of excitation or emission to convenient wavelengths compatible with the means of detection.

A variety of BODIPY molecules are commercially available in an amine reactive form which can be used to derivatize aminoacylated tRNAs. One example of a compound from this family which exhibits superior properties for incorporation of a detectable sequence tag into nascent proteins is 4,4-difluoro-5,7-dimethyl-4-bora-3a,4a-diaza-s-indacene (BODIPY-FL). When the sulfonated N-hydroxysuccinimide (NHS) derivative of BODIPY-FL is used to place a sequence tag on an $E.\ coli$ initiator $tRNA^{fmet}$, the labeled protein can be easily detected on polyacrylamide gels after electrophoresis using a standard UV-transilluminator and photographic or CCD imaging system. This can be accomplished by using purified $tRNA^{fmet}$ which is first aminoacylated with methionine and then the α-amino group of methionine is specifically modified using NHS-BODIPY. Varshney et al., "Direct analysis of aminoacylation levels of tRNA in vitro" $J.\ Biol.\ Chem.$ 266:24712-24718 (1991).

C. Unique Sequence Tags

Serial Analysis of Gene Expression (SAGE) is a technique that allows a rapid, detailed analysis of thousands of transcripts. SAGE is based on two principles. First, a short nucleotide sequence tag (i.e., for example, 9 to 10 base pairs (bps)) contains sufficient information to uniquely identify a transcript, provided it is isolated from a defined position within the transcript. For example, a sequence as short as 9 bp can distinguish 262,144 transcripts given a random nucleotide distribution at the tag site, whereas current estimates suggest that even the human genome encodes only about 80,000 transcripts. Second, concatenation of short sequence tags allows the efficient analysis of transcripts in a serial manner by the sequencing of multiple tags within a single clone. As with serial communication by computers, wherein information is transmitted as a continuous string of data, serial analysis of the sequence tags requires a means to establish the register and boundaries of each tag.

Double-stranded cDNA may then be synthesized from mRNA by means of a biotinylated oligo(dT) primer. The cDNA is then cleaved with a restriction endonuclease (anchoring enzyme) that can be expected to cleave most transcripts at least once. Typically, restriction endonucleases with 4-bp recognition sites are used for this purpose because they cleave every 256 bp on average, whereas most transcripts are considerably larger. The most 3' portion of the cleaved cDNA is then isolated by binding to streptavidin beads. This process provides a unique site on each transcript that corresponds to the restriction site located closest to the polyadenylated [poly (A)] tail. The cDNA is then divided in half and ligated via the anchoring restriction site to one of two linkers containing a type IIS (tagging enzyme). Type IIS restriction endonucleases cleaves at a defined distance up to 20 bp away from their asymmetric recognition sites. The linkers are designed so that cleavage of the ligation products with the tagging enzyme results in release of the linker with a short piece of the cDNA.

For example, a combination of anchoring enzyme and tagging enzyme that would yield a 9-bp tag can be cured. After blunt ends are created, the two pools of released tags are ligated to each other. Ligated tags then serve as templates for polymerase chain reaction (PCR) amplification with primers specific to each linker. This step serves several purposes in addition to allowing amplification of the tag sequences. First, it provides for orientation and punctuation of the tag sequence in a very compact manner. The resulting amplification products contain two tags (one ditag) linked tail to tail, flanked by sites for the anchoring enzyme. In the final sequencing template, this results in 4 bp of punctuation per ditag. Second and most importantly, the analysis of ditags, formed before any amplification steps, provides a means to completely eliminate potential distortions introduced by PCR. Because the probability of any two tags being coupled in the same ditag is small, even for abundant transcripts, repeated ditags potentially produced by biased PCR can be excluded from analysis without substantially altering the final results. Cleavage of the PCR product with the anchoring enzyme allows for the isolation of ditags that can then be concentrated by ligation, cloned, and sequenced.

In addition to providing quantitative information on the abundance of known transcripts, SAGE can be used to identify NDV expressed genes. SAGE can provide both quantitative and qualitative data about gene expression. The combination of different anchoring enzymes with various recognition sites and type IIS enzymes with cleavage sites 5 to 20 bp from their recognition elements lends great flexibility to this strategy.

D. Direct Detection Technology

When a sufficient amount of a nucleic acid to be detected is available, there are advantages to detecting that sequence directly, instead of making more copies of that target, (e.g., as in PCR and LCR). Most notably, a method that does not amplify the signal exponentially is more amenable to quantitative analysis. Even if the signal is enhanced by attaching multiple dyes to a single oligonucleotide, the correlation between the final signal intensity and amount of target is direct. Such a system has an additional advantage that the products of the reaction will not themselves promote further reaction, so contamination of lab surfaces by the products is not as much of a concern. Traditional methods of direct detection including Northern and Southern blotting and RNase protection assays usually require the use of radioactivity and are not amenable to automation. Recently devised techniques have sought to eliminate the use of radioactivity and/or improve the sensitivity in automatable formats. Two examples are the "Cycling Probe Reaction" (CPR), and "Branched DNA" (bDNA).

The cycling probe reaction (CPR), uses a long chimeric oligonucleotide in which a central portion is made of RNA while the two termini are made of DNA. Duck et al., *BioTech.*, 9:142 (1990). Hybridization of the probe to a target DNA and exposure to a thermostable RNase H causes the RNA portion to be digested. This destabilizes the remaining DNA portions of the duplex, releasing the remainder of the probe from the target DNA and allowing another probe molecule to repeat the process. The signal, in the form of cleaved probe molecules, accumulates at a linear rate. While the repeating process increases the signal, the RNA portion of the oligonucleotide is vulnerable to RNases that may be carried through sample preparation.

Branched DNA (bDNA) involves oligonucleotides with branched structures that allow each individual oligonucleotide to carry 35 to 40 labels (e.g., alkaline phosphatase enzymes). Urdea et al., *Gene* 61:253-264 (1987). While this enhances the signal from a hybridization event, signal from non-specific binding is similarly increased.

VII. In Vivo Vaccination

In one embodiment, the present invention contemplates a paramyxovirus VLP vaccine comprising at least one viral glycoprotein wherein the vaccine is antigenic. In one embodiment, the vaccine stimulates an immune response to diseases including, but not limited to, Newcastle disease, measles, parainfluenza virus 3, or respiratory syncytial virus infection. In one embodiment, the present invention contemplates a method comprising administering a purified antigenic paramyxovirus VLP vaccine to a host (i.e., for example, a mouse or chicken) under conditions that generate an immune response. In one embodiment, the immune response is characterized by measuring the serum glycoprotein antibody levels. In one embodiment, the viral glycoprotein comprises an NDV glycoprotein. In one embodiment, the viral glycoprotein comprises a measles virus glycoprotein. In one embodiment, the viral glycoprotein comprises a respiratory syncytial virus glycoprotein.

In one embodiment, the present invention contemplates a method comprising administering a purified antigenic NVD, measles, parainfluenza virus 3, or respiratory syncytial virus VLP vaccine to a chicken to create a vaccinated chicken. In one embodiment, the method further comprises administering a live virus challenge to the vaccinated chicken. In one embodiment, the method further comprises determining the NDV infection rate to the vaccinated chicken.

VIII. Vectors Containing Newcastle Disease Virus Sequences

The invention provides expression vectors containing Newcastle Disease Virus Sequences. These vectors are useful in, for example, generating VLPs that contain proteins of interest. In one embodiment, the expressed VLPs are capable of eliciting an immune response by an animal host against the protein.

The invention is premised, in part, on the inventor's discovery that expression of protein chimeras in which a heterologous type 1 protein, or a portion thereof, is flanked by a transmembrane domain and by a cytoplasmic domain of Newcastle Disease Virus fusion (F) protein results in expression of VLPs (see for example, Examples 29-31) that are capable of immunizing a host against the type 1 protein (see for example, Examples 34-36).

The invention is also based, in part, on the inventor's discovery that NDV proteins that are incorporated into VLPs elicit an immune response, and that foreign glycoproteins can be incorporated into VLPs (see, for example, Examples 32-36).

The invention is further premised, in part, on the inventor's discovery that expression of protein chimeras in which an epitope is expressed as a fusion protein with either the NDV HN protein or NDV NP protein resulted in the incorporation of the epitope into VLPs (see for example, Example 37).

In one embodiment, the invention provides a expression vector comprising, in operable combination: a) a nucleic acid sequence encoding a Newcastle Disease Virus matrix (M) protein, b) a first nucleic acid sequence encoding a transmembrane domain (TM) protein, c) a second nucleic acid sequence encoding Newcastle Disease Virus cytoplasmic domain (CT) protein, and c) a third nucleic acid sequence encoding a protein, wherein the first nucleic acid sequence is flanked by the second and third nucleic acid sequences. This is exemplified by FIGS. 164-171 and 177-178, and Examples 29-33 and 36-37.

The term "expression vector" as used herein refers to a recombinant DNA molecule containing a desired coding sequence and appropriate nucleic acid sequences necessary for the expression (i.e., transcription and/or translation) of the operably linked coding sequence in a host cell. Expression vectors are exemplified by, but not limited to, plasmid, phagemid, shuttle vector, cosmid, virus, chromosome, mitochondrial DNA, plastid DNA, and nucleic acid fragment. Nucleic acid sequences used for expression in prokaryotes include a promoter, optionally an operator sequence, a ribosome binding site and possibly other sequences. Eukaryotic cells are known to utilize promoters, enhancers, and termination and polyadenylation signals.

The terms "operable combination" and "operably linked" when in reference to the relationship between nucleic acid sequences and/or amino acid sequences refers to linking the sequences such that they perform their intended function. For example, operably linking a promoter sequence to a nucleotide sequence of interest refers to linking the promoter sequence and the nucleotide sequence of interest in a manner such that the promoter sequence is capable of directing the transcription of the nucleotide sequence of interest resulting in an mRNA that directs the synthesis of a polypeptide encoded by the nucleotide sequence of interest. The term also refers to the linkage of amino acid sequences in such a manner so that a functional protein is produced.

In another example, the nucleotide sequences encoding the TM domain and protein are operably linked if the vector containing the nucleotide sequences is capable of directing expression of the TM domain and of the protein. Thus, while not intending to limit the number of nucleotides between the nucleic acid sequence that encodes the TM domain and the nucleic acid sequence that encodes the protein of interest, in one embodiment, the vector may contain from 0 to 30 nucleotides between the nucleic acid sequence that encodes the TM domain and the nucleic acid sequence that encodes the protein of interest. In another embodiment, the vector contains from 0 to 3 nucleotides between the nucleic acid sequence that encodes the TM domain and the nucleic acid sequence that encodes the protein of interest (See, for example, FIGS. 165 and 168, and Examples 30 and 32).

Also, while not intending to limit the number of nucleotides between the nucleic acid sequence that encodes the TM domain and the nucleic acid sequence that encodes the Newcastle Disease Virus (NDV) cytoplasmic domain (CT), in one embodiment the vector may contain from 0 to 10 nucleotides between the nucleic acid sequence that encodes the TM domain and the nucleic acid sequence that encodes the NDV CT.

The term "flanked," when used in reference to, for example, a DNA sequence that is flanked by two nucleic acid sequences, means that one of the nucleic acid sequences is located near or at the 3'-end of the DNA sequence while the other nucleic acid sequence is located near or at the 5'-end of the DNA sequence. The term "flanked," when used in reference to, for example, a protein sequence that is flanked by two polypeptide sequences, means that one of the polypeptide sequences is located near or at the amino-terminal of the protein sequence while the other polypeptide sequence is located near or at the carboxy-terminal of the protein sequence.

A. Transmembrane Domain (TM)

In one embodiment, the invention's expression vectors are contemplated to contain nucleic acid sequences encoding a transmembrane domain. The terms "transmembrane domain" and "TM" are used interchangeably to refer to a protein sequence, and portions thereof, that spans the lipid bilayer of a cell, virus and the like. Methods for determining the TM of a protein are known in the art (Elofsson et al. (2007) Annu. Rev. Biochem. 76:125-140; Bemsel et al. (2005) Protein Science 14:1723-1728).

The TM may be derived from any membrane protein. In one embodiment, the TM is derived from a NDV protein, such as NDV F protein and NDV HN protein. In a particular embodiment, the nucleic acid sequence encodes one or more Newcastle Disease Virus fusion (F) protein transmembrane domain (TM) protein. This is useful in, for example, expressing type 1 proteins and portions thereof (see Examples 29-31), type 3 proteins and portions thereof, soluble proteins and portions thereof, and epitopes (see for example, Example 37). Exemplary Newcastle Disease Virus fusion (F) protein transmembrane domain (TM) proteins are shown in Table 4 (SEQ ID NOs: 303-317).

TABLE 4

Exemplary New Castle Disease Virus (NDV) F protein Cytoplasmic (CT) and Transmembrane (TM) Sequences

| Strain of NDV | TM | CT |
|---|---|---|
| AV | TSTSALITYIALTAISLVCGILSLVLACYLMY (SEQ ID NO: 303) | KQKAQQKTLLWLGNNTLGQMRATTKM (SEQ ID NO: 318) |
| QUE | TSTSALITYIVLTVISLVCGILSLVLACYLMY (SEQ ID NO: 304) | KQKAQQKTLLWLGNNTLGQMRATTKM (SEQ ID NO: 319) |
| ULS | TSTSALITYIVLTVISLVCGILSLVLACYLMY (SEQ ID NO: 305) | KQKAQQKTLLWLGNNTLGQMRATTKM (SEQ ID NO: 320) |
| B1 | TSTSALITYIVLTIISLVCGILSLILAFYLMY (SEQ ID NO: 306) | KQKAQQKTLLWLGNNTLGQMRATTKM (SEQ ID NO: 321) |
| LAS | TSTSALITYIVLTIISLVCGILSLILAFYLMY (SEQ ID NO: 307) | KQKAQQKTLLWLGNNTLGQMRATTKM (SEQ ID NO: 322) |
| TEX | TSTSALITYIVLTIISLVCGILSLVLAFYLMY (SEQ ID NO: 308) | KQKAQQKTLLWLGNNTLGQMRATTKM (SEQ ID NO: 323) |
| D26 | TSTSALITYIFLTVISLVCGILSLVLACYLMY (SEQ ID NO: 309) | KQKAQQKTLLWLGNNTLGQMRATTKM (SEQ ID NO: 324) |
| MIY | TSTSALITYIVLTVISLVCGILSLVLACYLMH (SEQ ID NO: 310) | KQKAQQKTLLWLGNNTLGQMRATTKA (SEQ ID NO: 325) |
| HER | TSTSALITYIVLTVISLVCGVLSLVLAFYLMY (SEQ ID NO: 311) | KQKAQQKTLLWLGNNTLGQMRATTKI (SEQ ID NO: 326) |
| ITA | TSTSALITYIVLTVISLVCGVLSLVLAFYLMY (SEQ ID NO: 312) | KQKAQQKTLLWLGNNTLGQMRATTKI (SEQ ID NO: 327) |
| MEX 37821-550-1/96 | TSTSALITYIVLAVVSLAFGVISLVLACYLMY (SEQ ID NO: 313) | KQKAQQKTLLWLGNNTLDQMRATTRT (SEQ ID NO: 328) |
| HOND 44815/00 | TSTSALITYIVLAVISLAFGVISLVLACYLMY (SEQ ID NO: 314) | KQKAQQKTLLWLGNNTLDQMRATTRT (SEQ ID NO: 329) |
| ZJ1-00 China | TSTSALITYIVLTVISLVFGALSLGLACYLMY (SEQ ID NO: 315) | KQKAQQKTLLWLGNNTLDQMRATTRA (SEQ ID NO: 330) |

TABLE 4-continued

Exemplary New Castle Disease Virus (NDV) F protein Cytoplasmic (CT) and Transmembrane (TM) Sequences

| Strain of NDV | TM | CT |
|---|---|---|
| SD6.04 China | TSTSALITYIVLTIISLVFGILSLVLACYLMY (SEQ ID NO: 316) | KQKAQQKTLLWLGNNTLDQMRATT (SEQ ID NO: 331) |
| JS2.98 China | INTSALITYIVLTVISLVFSALGLILGCYLMY (SEQ ID NO: 317) | KQKAQQKTLLWLGNNTLDQMRATT (SEQ ID NO: 332) |

In a further embodiment, the nucleic acid sequence encodes one or more Newcastle Disease Virus heamagglutinin-neuraminidase (HN) protein transmembrane domain (TM) protein. This is useful in, for example, expressing type 2 proteins and portions thereof (see Examples 32-33), type 3 proteins and portions thereof, soluble proteins and portions thereof, and epitopes (see for example, Example 37). Exemplary Newcastle Disease Virus HN protein transmembrane domain (TM) proteins are shown in Table 5 (SEQ ID NOs: 352-370).

TABLE 5

Exemplary New Castle Disease Virus (NDV) HN protein Cytoplasmic (CT) and Transmembrane (TM) Sequences

| Strain of NDV | CT | TM |
|---|---|---|
| AV | MNRAVCQVALENDEREAKNTWRLVFR (SEQ ID NO: 333) | IAILLLTVMTLAISAAALAYSM (SEQ ID NO: 352) |
| V | MNRAVCQVALENDEREAKNTWRLVFR (SEQ ID NO: 334) | IAILLLTVMTLAISAAALAYSM (SEQ ID NO: 353) |
| QUE | MDRAVSQVALENDEREAKNTWRLVFR (SEQ ID NO: 335) | IAILLSTVVTLAISAAALAYSM (SEQ ID NO: 354) |
| ULS | MDRAVSQVALENDEREAKNTWRLVFR (SEQ ID NO: 336) | IAILFLTVVTLAISAAALAYSM (SEQ ID NO: 355) |
| B1 | MDRAVSQVALENDEREAKNTWRLIFR (SEQ ID NO: 337) | IAILFLTVVTLAISVASLLYSM (SEQ ID NO: 356) |
| LAS | MDRAVSQVALENDEREAKNTWRLIFR (SEQ ID NO: 338) | IAILFLTVVTLAISVASLLYSM (SEQ ID NO: 357) |
| TEX | MDRAVSQVALENDEREAKNTWRLIFR (SEQ ID NO: 339) | IAILLLTVVTLATSVASLVYSM (SEQ ID NO: 358) |
| D26 | MDRAVSQVALENDEREAKNTWRLVFR (SEQ ID NO: 340) | IAILLLTVVTLAISAAALAYSM (SEQ ID NO: 359) |
| MIY | MDRTVNQVALENDEREAKNTWRLVFR (SEQ ID NO: 341) | IATLLLIVMTLAFSAAALAYSM (SEQ ID NO: 360) |
| HER | MDRAVSRVALENEEREAKNTWRFVFR (SEQ ID NO: 342) | IAILLLIVITLAISAAALVYSM (SEQ ID NO: 361) |
| ITA | MDLPVGRVALENEEREAKNTWRFVFR (SEQ ID NO: 343) | IAIFLLIVITLAISAAALVYSM (SEQ ID NO: 362) |
| CHI | MDRAVNRVVLENEEREAKNTWRLVFR (SEQ ID NO: 344) | IAVLLLMVMTLAISAAALVYSM (SEQ ID NO: 363) |
| IBA | MDRAVSRVVLENEEREAKNTWRFVFR (SEQ ID NO: 345) | IAVLLLIVMTLAISAAALVYSM (SEQ ID NO: 364) |
| JS-1/06 CHINA | MDRAVNRVVLENEEREAKNTWRLVF (SEQ ID NO: 346) | IAVLLLMVMTLAISAAALAYSTGAST (SEQ ID NO: 365) |
| GPMV QY97-1 CHINA | MDRAVNRVVLENEEREAKNTWRLVFR (SEQ ID NO: 347) | IAVLLLMVMTLAISSAALAYSTGAST (SEQ ID NO: 366) |
| ASTR/74 RUSSIA | MDRVVSRVVLENEEREAKNTWRLVFR (SEQ ID NO: 348) | IAVLLLIVMTLAISAAALVYSMGAIM (SEQ ID NO: 367) |

TABLE 5-continued

Exemplary New Castle Disease Virus (NDV) HN protein Cytoplasmic (CT) and Transmembrane (TM) Sequences

| Strain of NDV | CT | TM |
|---|---|---|
| MK13 IRAN | MDHTVNRVVLENEEREAKNTWRSVFR (SEQ ID NO: 349) | TTVLLLMVMTLAISIAALVYIMGAST (SEQ ID NO: 368) |
| US/CA 211472/02 UNITED STATES | MDRVVSRVVLENEEREAKNTWRLVFR (SEQ ID NO: 350) | IAVLSLVVMTLAISVATLVYSM (SEQ ID NO: 369) |
| MEXICO/96 37821-550 | MDRVVSRVVLENEEREAKNTWRLVFR (SEQ ID NO: 351) | IAVLSLIVMTLAISVAALVYSM (SEQ ID NO: 370) |

In another embodiment, the nucleic acid sequence encodes one or more transmembrane domain protein that is derived from a membrane protein other than from an NDV protein. This is useful in, for example, expressing type 1 proteins and portions thereof (see for example, Examples 29-31), type 2 proteins and portions thereof, type 3 proteins and portions thereof, soluble proteins and portions thereof, and epitopes (see for example, Example 37).

TM derived from proteins other than from an NDV protein include, but are not limited to, the TM of influenza virus HA protein (type 1 glycoprotein) (see, for example, FIG. 177), TM of influenza virus NA protein (type 2 glycoprotein) (see, for example, FIG. 178), TM of the G protein-coupled receptor (U.S. Pat. No. 7,105,488), TM of leucine zipper EF hand transmembrane receptor (U.S. Pat. No. 7,005,254), TM of *Escherichia coli* LipoF and OmpF proteins (U.S. Pat. No. 6,875,853), TM of *Escherichia coli* OmpA protein (U.S. Pat. No. 5,348,867), TM of human T cell receptor a chain (U.S. Pat. No. 6,696,545), TM of HLA class I and CD4 proteins (U.S. Pat. No. 6,423,316), TM of human MHC HLA-G protein (U.S. Pat. No. 6,291,659), TM of squalene synthetase (U.S. Pat. No. 5,589,372), and TM of CD4 and of CD8 (U.S. Pat. No. 5,250,431).

B. Newcastle Disease Virus Cytoplasmic Domain (CT)

In one embodiment, the invention's expression vectors are contemplated to contain a nucleic acid sequence encoding a Newcastle Disease Virus cytoplasmic domain. The terms "cytoplasmic domain," "cytoplasmic tail," and "CT" are used interchangeably to refer to a protein sequence, and portions thereof, that is on the cytoplasmic side of the lipid bilayer of a cell, virus and the like. Methods for determining the CT of a protein are known in the art (Elofsson et al. (2007) and Bermsel et al. (2005)).

In one embodiment, the nucleic acid sequence encodes a Newcastle Disease Virus fusion (F) protein cytoplasmic domain (CT) protein. This is useful in, for example, expressing type 1 proteins and portions thereof (see for example, Examples 29-31), type 3 proteins and portions thereof, soluble proteins and portions thereof, and epitopes (see for example, Example 37). Examples of NDV fusion (F) protein CT proteins are in Table 4, supra (SEQ ID NOs: 318-332).

In another embodiment, the nucleic acid sequence encodes a Newcastle Disease Virus heamagglutinin-neuraminidase (HN) protein cytoplasmic domain (CT) protein. This is useful in, for example, expressing type 2 proteins and portions thereof (see for example, Examples 32-33), type 3 proteins and portions thereof, soluble proteins and portions thereof, and epitopes (see for example, Example 37). Examples of NDV heamagglutinin-neuraminidase (HN) protein CT proteins are in Table 5, supra (SEQ ID NOs: 333-351).

C. Proteins of Interest

In one embodiment, the invention's expression vectors are contemplated to contain a nucleic acid sequence encoding a protein of interest. The term "protein of interest" refers to any protein, or portion thereof, that one of ordinary skill in the art may wish to use for any reason, including, without limitation, endogenous and heterologous proteins. The terms "endogenous" and "wild type" refer to a sequence that is naturally found in the cell, virus, or virus-like particle into which it is introduced so long as it does not contain some modification relative to the naturally-occurring sequence. The term "heterologous" refers to a sequence, which is not endogenous to the cell, virus, or virus-like particle into which it is introduced. For example, heterologous DNA includes a nucleotide sequence, which is ligated to, or is manipulated to become ligated to, a nucleic acid sequence to which it is not ligated in nature, or to which it is ligated at a different location in nature. Heterologous DNA also includes a nucleotide sequence, which is naturally found in the cell or VLP into which it is introduced and which contains some modification relative to the naturally-occurring sequence. Generally, although not necessarily, heterologous DNA encodes heterologous RNA and protein of interest that are not normally produced by the cell, virus, or virus-like particle into which it is introduced.

Examples of proteins of interest include proteins, and portions thereof, that are expressed as glycoproteins, membrane proteins and portions thereof, soluble proteins and portions thereof, epitopes and portions thereof, and the like.

The vectors of the invention may be used to express one or more protein of interest. Where it is desirable to simultaneously express more than one protein of interest, the invention contemplates that the simultaneously expressed proteins may be of the same type (e.g., type 1 protein, type 2 protein, type 3 protein, soluble protein, epitope). Alternatively, the simultaneously expressed proteins may be of different types (for example, type 1 protein combined with type 2 protein, type 1 protein combined with type 3 protein, etc.). Simultaneously expressed proteins may be encoded by nucleotide sequences that are on the same, or different, vectors.

a. Membrane Proteins

In one embodiment, the protein of interest comprises a membrane protein. A "membrane protein" refers to a protein that is at least partially embedded in the lipid bilayer of a cell, virus and the like. Membrane proteins include type 1 proteins, type 2 proteins, and type 3 proteins (Exemplified in Tables 6-11). Methods for determining the type of membrane protein are known (for example, Singer (1990) Annu. Rev. Cell Biol.

6:247-296 and High et al. (1993) J. Cell Biol. 121:743-750), including commercially available software, such as McVector software, Oxford Molecular.

In one embodiment, the protein of interest comprises an ectodomain of a membrane protein. The term "ectodomain" when in reference to a membrane protein refers to the portion of the protein that is exposed on the extracellular side of a lipid bilayer of a cell, virus and the like. Methods for determining the ectodomain of a protein are known in the art (Singer (1990); High et al. (1993), and McVector software, Oxford Molecular).

Exemplary ectodomains include, but are not limited to those described in U.S. Pat. Nos. 7,262,270; 7,253,254; 7,250,171; 7,223,390; 7,189,403; 7,122,347; 7,119,165; 7,101,556; 7,067,110; 7,060,276; 7,029,685; 7,022,324; 6,946,543; 6,939,952; 6,713,066; 6,699,476; 6,689,367; 6,566,074; 6,531,295; 6,417,341; 6,248,327; 6,140,059; 5,851,993; 5,847,096; 5,837,816; 5,674,753; and 5,344,760. Additional examples of ectodomains include ectodomains of membrane type 1 proteins (Table 7), type 2 proteins (Table 9), and type 3 proteins (Table 11).

In one embodiment, the protein of interest comprises a type 1 protein. The term "type 1 protein" refers to a membrane protein that contains one transmembrane domain (TM) sequence, which is embedded in the lipid bilayer of a cell, virus and the like. The portion of the protein on the $NH_2$-terminal side of the TM domain is exposed on the exterior side of the membrane, and the COOH-terminal portion is exposed on the cytoplasmic side. Exemplary type 1 proteins are described in Table 6.

TABLE 6

Exemplary Type 1 Proteins

| Source | Amino Acid Sequence | | Nucleotide Sequence | |
|---|---|---|---|---|
| | SEQ ID NO: | FIG. No. | SEQ ID NO: | FIG. No. |
| Fujian Strain of Influenza HA | 185 | 179 | 208 | 180 |
| Canine Distemper Virus Fusion Protein | 186 | 75 | — | — |
| Cytomegalovirus (CMV) gG glycoprotein | 187 | 76 | — | — |
| Cytomegalovirus gH Glycoprotein | 188 | 77 | 209 | 78 |
| Ebola virus Glycoprotein precursor | 189 | 79 | 210 | 80 |
| Human Immunodeficiency Virus (HIV) envelope protein | 190 | 81 | 211 | 82 |
| Herpes Simplex virus (HSV) gH glycoprotein | 191 | 83 | 212 | 84 |
| Herpes Simplex virus (HSV) gL Glycoprotein | 192 | 85 | 213 | 86 |
| Influenza virus HA-type H1 | 193 | 87 | — | — |
| Influenza Virus B HA | 214 | 88 | — | — |
| Influenza virus HA from influenza B Malaysia | 194 | 89 | 215 | 90 |
| Influenza virus HA second representative H1 | 195 | 91 | 216 | 92 |
| Influenza virus HA representative H3 | 196 | 93 | 217 | 94 |
| Influenza virus HA representative H5 HA | 197 | 95 | 218 | 96 |
| Influenza virus HA representative H7 HA | 198 | 97 | 219 | 98 |
| Influenza virus HA representative H9 HA | 199 | 99 | 220 | 100 |

TABLE 6-continued

Exemplary Type 1 Proteins

| Source | Amino Acid Sequence | | Nucleotide Sequence | |
|---|---|---|---|---|
| | SEQ ID NO: | FIG. No. | SEQ ID NO: | FIG. No. |
| Nipah virus F protein | 200 | 101 | 221 | 102 |
| Respiratory Syncytial Virus (RSV) F protein (first example) | 201 | 103 | 222 | 104 |
| Respiratory Syncytial Virus F protein (second example) | 202 | 105 | — | — |
| SARS virus surface spike glycoprotein | 203 | 106 | 223 | 107 |
| Varicella Zoster Virus gB glycoprotein | 205 | 108 | 224 | 109 |
| Varicella Zoster Virus gE glycoprotein | 206 | 110 | 225 | 111 |
| Varicella Zoster Virus gI glycoprotein | 207 | 112 | 226 | 113 |

In another embodiment, the protein of interest comprises an ectodomain of a type 1 protein. The term "ectodomain" of a type 1 protein refers to at least a portion of the type 1 protein on the $NH_2$-terminal side of the TM domain that is exposed on the exterior side of the membrane. Exemplary type 1 protein ectodomains are listed in Table 7.

TABLE 7

Exemplary Ectodomain Sequences of Type 1 Proteins

| Source | Amino Acid Sequence | |
|---|---|---|
| | SEQ ID NO: | FIG. No. |
| Influenza Virus Fujian strain HA protein | 251 | 206 |
| CMV gB protein | 252 | 207 |
| CMV gH protein | 253 | 208 |
| Ebola G protein | 254 | 209 |
| Influenza virus HA H1 protein | 255 | 210 |
| Influenza virus B HA protein | 256 | 211 |
| Influenza virus H3 HA protein | 257 | 212 |
| HIV envelope protein | 258 | 213 |
| HSV gH protein | 259 | 214 |
| Influenza virus H7 HA protein | 260 | 215 |
| Influenza virus H9 protein | 261 | 216 |
| Influenza Virus H5 protein | 262 | 217 |
| Nipah virus F protein | 263 | 218 |
| Respiratory Syncytial virus F protein | 264 | 219 |
| Respiratory Syncytial virus F protein | 265 | 220 |
| SARS virus S glycoprotein | 266 | 221 |
| Varicella Zoster Virus gB protein | 267 | 222 |
| Varicella Zoster Virus gE protein | 268 | 223 |
| Varicella Zoster Virus gI protein | 269 | 224 |

Data herein shows expression of the exemplary type 1 protein ectodomain of influenza virus Fujian strain HA protein (SEQ ID NO: 251) (see for example, Examples 29-31).

In a further embodiment, the protein of interest comprises a type 2 protein. The term "type 2 protein" refers to a membrane protein that contains one transmembrane domain (TM) sequence, which is embedded in the lipid bilayer of a cell, virus and the like. In contrast to type 1 proteins, in type 2 proteins the portion of the protein on the $NH_2$-terminal side of the TM domain is exposed on the cytoplasmic side of the membrane, and the COOH-terminal portion is exposed on the exterior side. Exemplary type 2 proteins as shown in Table 8.

TABLE 8

Exemplary Type 2 Proteins

| Source | Amino Acid Sequence SEQ ID NO: | FIG. No. | Nucleotide Sequence SEQ ID NO: | FIG. No. |
|---|---|---|---|---|
| Fujian Influenza NA | 114 | 181 | 132 | 182 |
| Canine Distemper Virus H Glycoprotein | 115 | 114 | — | — |
| Avian Metapneumovirus G Protein | 116 | 115 | 133 | 116 |
| Human Metapneumovirus G Glycoprotein | 117 | 117 | 134 | 118 |
| Human Respiratory Syncytial Virus G Glycoprotein | 118 | 119 | — | — |
| Influenza Virus B NA Glycoprotein | 119 | 120 | — | — |
| Influenza Virus N1 NA from H5N1 Virus | 120 | 121 | 135 | 122 |
| Influenza Virus NA N2 (first example) | 121 | 123 | — | — |
| Influenza Virus NA N2 type (second example) | 122 | 124 | 136 | 125 |
| Influenza Virus NA N3 type | 123 | 126 | 137 | 127 |
| Measles Virus HA Protein | 124 | 128 | 138 | 129 |
| Mumps Virus HN | 125 | 130 | 139 | 131 |
| Nipah Virus G Protein | 126 | 132 | 140 | 133 |
| Parainfluenza Virus Type 2 HN Protein | 127 | 134 | 141 | 135 |
| Parainfluenza Virus 3 HN Glycoprotein (first example) | 128 | 136 | — | — |
| Parainfluenza 3 Virus HN (second example) | 129 | 137 | 142 | 138 |
| Respiratory Syncytial Virus G Protein | 130 | 139 | 143 | 140 |
| Vaccinia Virus Surface Antigen | 131 | 141 | 144 | 142 |

In a particular embodiment, the protein of interest comprises an ectodomain of a type 2 protein. The term "ectodomain" of a type 2 protein refers to at least a portion of the type 2 protein on the COOH-terminal side of the TM domain that is exposed on the exterior side of the membrane. Examples of type 2 protein ectodomains are listed in Table 9.

TABLE 9

Exemplary Ectodomain Sequences of Type 2 Proteins

| Source | Amino Acid Sequence SEQ ID NO: | FIG. No. |
|---|---|---|
| Influenza Virus Fujian strain NA protein | 270 | 225 |
| Metapneumovirus G protein | 271 | 226 |
| Influenza Virus B NA protein | 272 | 227 |
| Human Metapneumovirus G protein | 273 | 228 |
| Human respiratory Syncytial virus G protein | 274 | 229 |
| Influenza virus N1 NA protein | 275 | 230 |
| Influenza virus N3 NA protein | 276 | 231 |
| Influenza virus N2 NA protein | 277 | 232 |
| Measles virus HA protein | 278 | 233 |
| Mumps virus HN protein | 279 | 234 |
| Nipah virus G protein | 280 | 235 |
| Parainfluenza 2 virus HN protein | 281 | 236 |
| Parainfluenza virus 3 HN protein | 282 | 237 |
| Vaccinia virus surface protein | 283 | 238 |

Data herein shows expression of the exemplary type 2 protein ectodomain of influenza virus Fujian strain NA protein (SEQ ID NO: 270) (see for example, Examples 32-33).

In yet another embodiment, the protein of interest comprises a type 3 protein. The term "type 3 protein" refers to a membrane protein that contains more than one transmembrane domain (TM) sequence containing hydrophobic amino acids, which are embedded in the lipid bilayer of a cell, virus and the like. The portion of the protein on the NH$_2$-terminal side of the TM domain may be exposed on either the cytoplasmic side or the exterior side of the membrane. Conversely, the portion of the protein on the COOH-terminal side of the TM domain may be exposed on either the cytoplasmic side or the exterior side of the membrane. Exemplary type 3 proteins are listed in Table 10.

TABLE 10

Exemplary Type 3 Proteins

| Source | Amino Acid Sequence SEQ ID NO: | FIG. No. | Nucleotide Sequence SEQ ID NO: | FIG. No. |
|---|---|---|---|---|
| Epstein Barr Virus (EBV) LMP2A protein | 145 | 143 | 150-157 | 144 |
| Glut 1 HTLV receptor protein | 146 | 145 | 158 | 146 |
| Glutamate Receptor protein | 147 | 147 | 159 | 148 |
| Hepatitis B virus L form of S glycoprotein | 148 | 149 | 160 | 150 |
| Prion Protein | 149 | 151 | 161 | 152 |
| Presenilin (human) protein | 250 | 205 | — | — |

In a particular embodiment, the protein of interest comprises an ectodomain of a type 3 protein. The term "ectodomain" of a type 3 protein refers to at least a portion of the type 3 protein of either the NH$_2$-terminal or the COOH-terminal side of the TM domain that is exposed on the exterior side of the membrane. Table 11 lists some examples of type 3 protein ectodomains.

TABLE 11

Exemplary Ectodomain Sequences of Type 3 Proteins Amino Acid Sequence

| Source | Sequence | Amino Acid Sequence SEQ ID NO: | Figure No. |
|---|---|---|---|
| Prion protein | — | 284 | 239 A |
| Prion protein | — | 285 | 239 B |
| Glut-1 protein | EEFYNQTWVHRYGES | 286 | — |
| Glut-1 protein | FEKAGVQQP | 287 | — |
| Glut-1 protein | EQLCGPY | 288 | — |
| LMP2A protein | SSYAAAQRK | 289 | — |
| LMP2A protein | RRRWRRLTVCGGIM | 290 | — |
| Presenilin protein | TFGLVFYFATDYLVQP FMDQLAFHQFYI | 291 | — |
| Hepatitis B virus L form of HBsAg protein | — | 292 | 240 | b. Soluble Proteins

In one embodiment, the protein of interest comprises a soluble protein. The term "soluble protein" refers to a protein that is not embedded in the lipid bilayer of a cell, virus and the like. Examples of soluble proteins are listed in Table 12.

TABLE 12

Exemplary Soluble Proteins

| Source | Amino Acid Sequence | | Nucleotide Sequence | |
|---|---|---|---|---|
| | SEQ ID NO: | FIG. No. | SEQ ID NO: | FIG. No. |
| Hepatitis A Virus VP1 | 162 | 153 | 167 | 154 |
| Human Parvovirus VP (B19 Virus) | 163 | 155 | 168 | 156 |
| Norovirus VP1 | 164 | 157 | 169 | 158 |
| Human Rhinovirus VP1 | 165 | 159 | 170 | 160 |
| Human Rotavirus (strain K8) VP4 | 166 | 161 | 171 | 162 | c. Antigens and Epitopes

In one embodiment, the protein of interest comprises an antigen. The terms "antigen," "immunogen," "antigenic," "immunogenic," "antigenically active," and "immunologically active" when made in reference to a molecule, refer to any substance that is capable of inducing a specific humoral and/or cell-mediated immune response.

In one embodiment, the antigen comprises an epitope. The terms "epitope" and "antigenic determinant" refer to a structure on an antigen, which interacts with the binding site of an antibody or T cell receptor as a result of molecular complementarity. An epitope may compete with the intact antigen, from which it is derived, for binding to an antibody. Generally, secreted antibodies and their corresponding membrane-bound forms are capable of recognizing a wide variety of substances as antigens, whereas T cell receptors are capable of recognizing only fragments of proteins which are complexed with MHC molecules on cell surfaces. Antigens recognized by immunoglobulin receptors on B cells are subdivided into three categories: T-cell dependent antigens, type 1 T cell-independent antigens; and type 2 T cell-independent antigens. Also, for example, when a protein or fragment of a protein is used to immunize a host animal, numerous regions of the protein may induce the production of antibodies which bind specifically to a given region or three-dimensional structure on the protein; these regions or structures are referred to as antigenic determinants. An antigenic determinant may compete with the intact antigen (i.e., the immunogen used to elicit the immune response) for binding to an antibody.

Exemplary epitopes include, without limitation YPYDVP-DYA (SEQ ID NO: 227) (see for example, Example 37), EphrinA2 epitopes from renal cell carcinoma and prostate cancer (U.S. Pat. No. 7,297,337), hepatitis C virus epitopes (U.S. Pat. Nos. 7,238,356 and 7,220,420), vaccinia virus epitopes (U.S. Pat. No. 7,217,526), dog dander epitopes (U.S. Pat. No. 7,166,291), human papilloma virus (HPV) epitopes (U.S. Pat. Nos. 7,153,659 and 6,900,035), *Mycobacterium tuberculosis* epitopes (U.S. Pat. Nos. 7,037,510 and 6,991,797), bacterial meningitis epitopes (U.S. Pat. No. 7,018,637), malaria epitopes (U.S. Pat. No. 6,942,866), and type 1 diabetes mellitus epitopes (U.S. Pat. No. 6,930,181).

Data herein (see for example, Example 37) shows that the exemplary CTL epitope sequence YPYDVPDYA (SEQ ID NO: 227) was incorporated into VLPs following its expression as a fusion protein to the carboxyl terminus of NDV HN protein, to the amino terminus of NDV NP protein, or to the carboxyl terminus of NDV NP protein.

Exemplary vectors that are useful for expressing type 1 proteins, and portions thereof, contain a nucleic acid sequence that encodes a type 1 protein in operable combination with a nucleic acid sequence that encodes a Newcastle Disease Virus fusion (F) protein cytoplasmic domain (CT) protein. More preferably, but without limitation, the vector further comprises a nucleic acid sequence that encodes a Newcastle Disease Virus fusion (F) protein transmembrane domain (TM) protein. This combination is exemplified in Examples 29-31 and 36, and FIGS. 164-167 and 177.

The efficiency of expressing type 1 proteins in ND VLPs may be increased by co-expression of other Newcastle Disease Virus proteins (see for example Table 14 and FIG. 172). In one embodiment, the efficiency of expressing type 1 proteins in ND VLPs may be increased by co-expression of Newcastle Disease Virus nucleocapsid (NP) protein and Matrix (M) protein (see for example, Example 31, FIG. 167). Improved efficiency of expressing VLPs that contain type 1 proteins may also be obtained upon co-expression of Newcastle Disease Virus nucleocapsid (NP) protein, Matrix (M) protein, and fusion (F) protein (see for example, Example 31, FIG. 167). In another embodiment, VLPs that contain type 1 proteins are produced upon co-expression of Newcastle Disease Virus nucleocapsid (NP) protein, Matrix (M) protein, and NDV heamagglutinin-neuraminidase (HN) protein (see for example, Example 31, FIG. 167).

In one embodiment, NDV NP amino acid and nucleotide sequences are exemplified by SEQ ID NOs: 6, 7, 22 and 23 (see for example, FIGS. 8 and 24). In another embodiment, NDV HN amino acid and nucleotide sequences are exemplified by SEQ ID NOs: 8, 9 and 15-18 (see for example, FIGS. 9, 20 and 21). In a further embodiment, NDV F amino acid and nucleotide sequences are exemplified by SEQ ID NOs: 10, 11, 19-21 (see for example, FIGS. 10, 22 and 23). In another embodiment, NDV M amino acid and nucleotide sequences are exemplified by the sequences in Table 13.

Exemplary vectors that are useful for expressing type 2 proteins, and portions thereof, contain a nucleic acid sequence that encodes a type 2 protein in operable combination with a nucleic acid sequence that encodes a Newcastle Disease Virus heamagglutinin-neuraminidase (HN) protein cytoplasmic domain (CT) protein. In one embodiment, the vector further comprises a nucleic acid sequence that encodes a Newcastle Disease Virus heamagglutinin-neuraminidase (HN) protein transmembrane domain (TM) protein. This combination is exemplified in Examples 32-33 and 37, and FIGS. 168-171 and 178.

The efficiency of expressing type 2 proteins in ND VLPs may be increased by co-expression of other Newcastle Disease Virus proteins. In one embodiment, the efficiency of expressing type 2 proteins in ND VLPs may be increased by co-expression of Newcastle Disease Virus nucleocapsid (NP) protein and Matrix (M) protein (see for example, Example 33, FIG. 171). Improved efficiency of expressing VLPs that contain type 2 proteins may also be obtained upon co-expression of Newcastle Disease Virus nucleocapsid (NP) protein, Matrix (M) protein, and fusion (F) protein (see for example, Example 33, FIG. 171). In a further embodiment, improved efficiency of expressing VLPs that contain type 2 proteins may also be obtained upon co-expression of Newcastle Disease Virus nucleocapsid (NP) protein, Matrix (M) protein, fusion (F) protein and heamagglutinin-neuraminidase (HN) protein (see for example, Example 33, FIG. 171).

Exemplary vectors that are useful for expression of at least a portion of a type 3 protein, of a soluble protein, and of an epitope, contain nucleic acid sequences encoding these proteins of interest in operable combination with a nucleic acid sequence that encodes a Newcastle Disease Virus fusion (F) protein transmembrane domain (TM) protein, and a nucleic acid sequence that encodes a Newcastle Disease Virus fusion (F) protein cytoplasmic domain (CT) protein. This combination may be used to express the amino-terminal portion of the protein of interest on the outside surface of the expressed NDV VLP.

In an alternative embodiment for expression of at least a portion of a type 3 protein, of a soluble protein, and of an epitope, the vector contains nucleic acid sequences encoding the protein of interest in operable combination with a nucleic acid sequence that encodes a Newcastle Disease Virus heamagglutinin-neuraminidase (HN) protein transmembrane domain (TM) protein, and a nucleic acid sequence that encodes a Newcastle Disease Virus heamagglutinin-neuraminidase (HN) protein cytoplasmic domain (CT) protein. This combination may be used to express the carboxy-terminal portion of the protein of interest on the outside surface of the expressed NDV VLP.

D. Matrix Protein

In one embodiment, the invention's expression vectors are contemplated to contain nucleic acid sequences encoding Newcastle Disease Virus Matrix (M) protein, such as those exemplified in Table 13 (see, for example, Examples 29-33, 36 and 37, and FIGS. 164-171 and 177-178).

TABLE 13

Exemplary M protein from Newcastle Disease Virus (NDV) Strains

| GenBank Accession No. | Amino Acid Sequence | | Nucleotide Sequence | |
|---|---|---|---|---|
| | SEQ ID NO: | FIG. No. | SEQ ID NO: | FIG. No. |
| AY728363 | 12 | 11A | 13 | 11B |
| M16622 | 24 | 25A | 25 | 25B |
| U25828 | 26 | 26A | 27 | 26B |
| AF431744 | 228 | 183 | 239 | 184 |
| NC_002617 | 229 | 185 | 240 | 186 |
| AY562986 | 230 | 187 | 241 | 188 |
| AY562989 | 231 | 189 | 242 | 190 |
| AY562988 | 232 | 191 | 243 | 192 |
| AY562990 | 233 | 193 | 244 | 194 |
| AY845400 | 234 | 195 | 245 | 196 |
| AJ880277 | 235 | 197 | 246 | 198 |
| EU293914 | 236 | 199 | 247 | 200 |
| AF431744 | 237 | 201 | 248 | 202 |
| AY562991 | 238 | 203 | 249 | 204 |

Sequences that encode Newcastle Disease Virus matrix (M) protein may be located on expression vectors that are "the same or different" from sequences that encode the transmembrane domain (TM) protein, cytoplasmic domain (CT) protein, and protein of interest. Thus, in one embodiment, an expression vector that contains sequences encoding the transmembrane domain (TM) protein, cytoplasmic domain (CT) protein, and protein of interest may additionally contain sequences encoding Newcastle Disease Virus matrix (M) protein. In another embodiment, as exemplified in Examples 28-37 herein, sequences encoding Newcastle Disease Virus matrix (M) protein are located on a different vector from the vector that contains sequences encoding the transmembrane domain (TM) protein, cytoplasmic domain (CT) protein, and protein of interest IX. Newcastle Disease VLPs The invention provides recombinant virus-like particle (VLP) comprising any one of the expression vectors disclosed herein. The invention's VLPs are useful in, for example, eliciting an immune response to a protein expressed on the VLPs. This may be used to immunize a recipient host against the protein. Alternatively, the antibodies that are generated may be used for detection of the protein, such as in ELISA assays.

In one embodiment, the VLP comprises: a) a Newcastle disease virus matrix (M) protein, b) a transmembrane domain (TM) protein, c) a Newcastle Disease Virus cytoplasmic domain (CT) protein, and d) a protein of interest, wherein said TM protein is flanked by said CT protein and said protein of interest.

In one embodiment, the virus-like particle (VLP) is purified. The terms "purified" and "isolated" and grammatical equivalents thereof as used herein, refer to the reduction in the amount of at least one undesirable contaminant (such as protein and/or nucleic acid sequence) from a sample. Thus, purification results in an "enrichment," i.e., an increase in the amount of a desirable composition, such as VLP, protein and/or nucleic acid sequence in the sample.

In one embodiment, the invention's VLPs express the protein of interest on the outside surface of the virus-like particle (VLP), thereby making the protein available for eliciting an immune response upon introduction of the VLP into a host.

Methods for determining that proteins are expressed on the outer surface of a VLP are exemplified by those described herein, Example 30 and FIG. 165, for biotinylation of cell surface proteins that are expressed by cells that harbor constructs for VLP expression (McGinnes et al. (2006) J. Virol. 80:2894-2903). In addition, expression of the protein of interest on the outer surface of VLPs may also be determined by using the VLPs to produce antibodies, such as in an animal, egg cell, or tissue culture. The production of an antibody that specifically binds to the protein of interest indicates that the protein of interest is expressed on the outside surface of the VLP.

In one embodiment, the virus-like particles (VLPs) of the invention are comprised in a vaccine. The term "vaccine" refers to a preparation that may be administered to a host to induce a cellular and/or antibody immune response. Vaccines may contain pharmaceutically acceptable carriers, diluents or excipients. Data herein shows that exemplary VLPs of the invention elicited a soluble antibody response as well as increased CTL activity (see for example, Example 35).

In one embodiment, the efficiency of producing the invention's virus-like particles (VLPs) is at least 10 fold greater, at least 20 fold greater, and/or at least 30 fold greater than the efficiency of producing influenza virus-like particles (VLPs). In one embodiment, the efficiency of producing the virus-like particles (VLPs) is from 30 to 100 fold greater than the efficiency of producing influenza virus-like particles (VLPs). Data in Example 28 and FIG. 163 demonstrate the surprising result that ND VLP release was approximately 30 to 100 fold higher over a 24 hour period than that of influenza VLPs.

The term "efficiency" when in reference to production of VLPs by a cell refers to the number of VLPs produced by a cell, such as following expression of an expression vector by those cells. The number of VLPs may be determined directly or indirectly by, for example, quantifying the amount of protein expressed in the VLPs, such as NDV matrix (M) protein, influenza matrix (M1) protein, and NDV heamagglutinin-neuraminidase (HN) protein.

In one embodiment, the virus-like particle (VLP) is immunogenic. The term "immunogenic" refers to a molecule that is capable of eliciting an immune response in a host animal, including producing an antibody response and/or a cell mediated immune response (for example, involving cytotoxic T lymphocytes (CTL)).

Exemplary host animals include, without limitation, mammals, avians, amphibians, reptiles, and insects. Data herein shows the use of exemplary mice as recipients of the invention's exemplary VLPs (see for example, Examples 34-35).

In one embodiment, the immune response comprises production of an antibody that specifically binds to the protein of interest that is expressed on the VLP. The terms "specific binding" or "specifically binding" when used in reference to the interaction of an antibody or cell (such as a lymphocyte cell) with another molecule (such as a protein or peptide), means that the interaction is dependent upon the presence of a particular structure (i.e., the antigenic determinant or epitope) on the molecule. For example, if an antibody is specific for epitope "A," the presence of a protein containing epitope A (or free, unlabelled A) in a reaction containing labeled "A" and the antibody will reduce the amount of labeled A that is bound to the antibody. Similarly, if a lymphocyte cell is specific for epitope "A," the presence of a protein containing epitope A (or free, unlabelled A) in a reaction containing labeled "A" and the lymphocyte cell will reduce the amount of labeled A that is bound to the lymphocyte cell.

Data herein demonstrates that the invention's exemplary VLPs produced an antibody response against the exemplary NDV glycoproteins (see for example, Example 35, FIG. 173).

In another embodiment, the immune response comprises increasing the number of T lymphocytes that specifically bind to the protein of interest. The term "T lymphocytes" includes, but is not limited to, one or more of cytotoxic T cells (CTLs), helper T cells, and suppressor T cells. T lymphocytes express receptors that recognize antigen in the form of peptide fragments complexed with MHC molecules.

The terms "increase," "elevate," "raise," and grammatical equivalents (including "higher," "greater," etc.) when in reference to the level of any molecule (e.g., VLP, amino acid sequence, nucleic acid sequence, etc.) and/or phenomenon (e.g., immune response, binding to a molecule, efficiency of expression of a nucleic acid sequence, etc.) in a first sample relative to a second sample, mean that the quantity of the molecule and/or phenomenon in the first sample is higher than in the second sample by any amount that is statistically significant using any art-accepted statistical method of analysis. In one embodiment, the quantity of the molecule and/or phenomenon in the first sample is at least 10% greater than, at least 25% greater than, at least 50% greater than, at least 75% greater than, and/or at least 90% greater than the quantity of the same molecule and/or phenomenon in a second sample.

The terms "reduce," "inhibit," "diminish," "suppress," "decrease," and grammatical equivalents (including "lower," "smaller," etc.) when in reference to the level of any molecule (e.g., VLP, amino acid sequence, nucleic acid sequence, etc.) and/or phenomenon (e.g., immune response, binding to a molecule, efficiency of expression of a nucleic acid sequence, etc.) in a first sample relative to a second sample, mean that the quantity of molecule and/or phenomenon in the first sample is lower than in the second sample by any amount that is statistically significant using any art-accepted statistical method of analysis. In one embodiment, the quantity of the molecule and/or phenomenon in the first sample is at least 10% lower than, at least 25% lower than, at least 50% lower than, at least 75% lower than, and/or at least 90% lower than the quantity of the same molecule and/or phenomenon in a second sample.

Data herein demonstrates an increase in CTL activity against NDV proteins after immunization with the invention's exemplary VLPs that contain NDV proteins (see for example, Example 39, FIG. 175). Data herein further demonstrate that in response to immunization with the invention's exemplary VLPs that express influenza virus proteins, there was an increase in the percentage of CD8+ spleen cells that were positive for Interferon γ and an increase in the percentage of CD4+ spleen cells that were positive for Interferon γ (see for example, Example 39, FIG. 176).

EXPERIMENTAL

The following examples are only illustrative of specific embodiments of the present invention and are not intended as limiting.

Example 1

Cell Cultures

This example describes the cell cultures used in the Examples below to construct specific embodiments of the present invention.

A spontaneously transformed fibroblast cell line derived from the East Lansing strain (ELL-O) of chicken embryos (UMNSAH/DF-1) was obtained from the American Type Culture Collection and maintained in Dulbecco's modified Eagle medium (DMEM) supplemented with penicillin-streptomycin and 10% fetal calf serum (FCS).

Human renal epithelial cells expressing the SV 40 T antigen (293T) were also propagated in DMEM supplemented with 10% FCS, penicillin-streptomycin, vitamins, non-essential amino acids, and glutamine. NDV, strain A V, was propagated in embryonated chicken eggs by standard protocols.

Example 2

Plasmids

This example describes the types of plasmids used in the Examples below to construct various embodiments of the present invention.

NDV cDNA sequences encoding NP (i.e., for example, SEQ ID NO:23), M (i.e., for example, SEQ ID NO:27), HN (i.e., for example, SEQ ID NO:18), and uncleaved F (i.e., for example, SEQ ID NO:20 or, alternatively, an F-K115Q) proteins were subcloned into the expression vector pCAGGS to generate pCAGGS-NP, pCAGGS-M, pCAGGS-HN and pCAGGS-F-K115Q, respectively. Miyazaki et al., "Expression vector system based on the chicken beta-actin promoter directs efficient production of interleukin-5" *Gene* 79:269-77 (1989); and Niwa et al., "Efficient selection for high-expression transfectants with a NDVel eukaryotic vector" *Gene* 108:193-9 (1991).

F protein cDNA contains a point mutation in the cleavage site sequence, F-K115Q, which eliminates the furin recognition site. Li et al., "Effect of cleavage mutants on syncytium formation directed by the wild-type fusion protein of Newcastle disease virus" *J. Virol.* 72:3789-95 (1998).

pBJ5 expression vector containing the gene encoding a Flag-tagged Vps4A with E228Q mutation and pDsRed2-N1 vector (Clontech) containing the gene encoding the CHMP3-RFP fusion protein were previously described. Strack et al., "PIP1/ALIX is a binding partner for HIV-1 p6 and EIAV p9 functioning in virus budding" *Cell* 114:689-699 (2003).

Example 3

Transfection, Infection, And Metabolic Labeling

This examples describes the basic techniques used to develop and express various embodiments of the present invention.

Transfections of sub-confluent ELL-O cells and/or 293T cells were accomplished using Lipofectamine (Invitrogen) as recommended by the manufacturer. The following amounts of plasmid DNA were used per 35 mm dish: 1.0 μg pCAGGS-NP, 1.0 μg pCAGGS-M, 0.75 μg pCAGGS-F-K115Q, and 1.0 μg pCAGGS-HN, either alone or in mixtures. These amounts were previously determined to yield levels of expression similar to cells infected with NDV at a multiplicity of infection of 5.

A total of 3.75 μg of plasmid DNA per 35 mm plate was used in all transfection experiments. When only one, two, or three cDNAs were used, the total amount of transfected DNA was kept constant by adding vector pCAGGS DNA. For each transfection, a mixture of DNA and 5 μl of Lipofectamine in OptiMEM media (Gibco/Invitrogen) was incubated at room temperature for 45 minutes, and added to cells previously washed with OptiMEM. The cells were incubated for 5 hours, the Lipofectamine-DNA complexes were removed, and 2 ml of supplemented DMEM was added.

After 36 hours, the medium was replaced with 0.7 ml DMEM without cysteine and methionine and supplemented with 100 μCi of $^{35}$S-methionine and $^{35}$S-cysteine mixture (NEG-772 EASYTAG™ Express Protein Labeling Mix, $^{35}$S, Perkin Elmer Life Sciences Inc.). After 4 hours of pulse label, one set of transfected plates was lysed, while in another set the medium was replaced with 1.0 ml of supplemented DMEM with 0.1 mM cold methionine (Nutritional Biochemicals Corporation). After 8 hours of chase, the medium was collected and the cells were lysed in 0.5 ml lysis buffer containing Triton-DOC (1% Triton, 1% sodium deoxycholate) and 25 mg N-ethylmaleimide (NEM). Cells were harvested with a cell scraper and homogenized by passing through a 26 gauge needle 10 to 15 times.

Sub-confluent 293T cells were simultaneously transfected with pCAGGS-M and different concentrations of either pBJ5-Vps4-E228Q-Flag or pDsRed2-N1-CHMP3. Corresponding empty vectors were used as control. Cells were incubated for 36 hours and the same pulse-chase protocol was performed as described above.

ELL-O cells were infected at an MOI of 5 pfu for 5 hours, labeled with $^{35}$S-methionine and $^{35}$S-cysteine mixture for 30 min, and chased in nonradioactive medium for 8 hours as described above. Cell supernatant was harvested and virions purified as described below. Cells were lysed and homogenized as described above.

Example 4

VLP Purification And Isolation

Virus and VLP, as well as virions, were purified from cell supernatants in protocols previously reported. Levinson et al., "Radiation studies of avian tumor viruses and Newcastle disease virus" *Virology* 28:533-542 (1966). The cell supernatants were centrifuged at 5000 rpm for 5 min at 4° C., overlaid on top of a block gradient consisting of 3.5 ml 20% and 0.5 ml 65% sucrose solutions in TNE buffer (25 mM Tris-HCl pH 7.4, 150 mM NaCl, 5 mM EDTA), and re-centrifuged at 40,000 rpm for 12 hours at 4° C. using a SW50.1 rotor (Beckman). The sucrose gradient interface (containing concentrated particles) was collected in 0.5 ml, mixed with 2.0 ml of 80% sucrose, and overlaid on top of 1.0 ml 80% sucrose cushion. Additional layers of sucrose (1.0 ml of 50% and 0.5 ml of 10% sucrose) were layered on top of the sample. The gradient was centrifuged at 38,000 rpm for 20 h at 4° C. The gradient was collected from the bottom into one 1 ml fraction and eight 0.5 ml fractions using a polystaltic pump. Densities of each fraction were determined using a refractometer. VLPs derived from expression of all combinations of proteins were prepared in a single experiment, thus enabling direct comparison of results.

The experiments were repeated three times. Immunoprecipitation and polyacrylamide gel electrophoresis. Immunoprecipitation was accomplished by combining one volume of cell lysate or sucrose gradient fraction with two volumes of TNE buffer. Samples were incubated with specific antibodies for 16 hours at 4° C. Antisera used to precipitate NP, F and HN were rabbit polyclonal antibody raised against UV inactivated NDV by standard protocols; anti-HR1 and anti-HR2McGinnes et al., "Newcastle disease virus HN protein alters the conformation of the F protein at cell surfaces" *J. Virol.* 76:12622-33 (2002); anti-F2-96 and anti-A. McGinnes et al., "Role of carbohydrate processing and calnexin binding in the folding and activity of the HN protein of Newcastle disease virus" *Virus Res* 53:175-85 (1998).

Anti-F2-96 was raised against a glutathione S-transferase (GST) fusion protein that contained the F protein sequences from amino acid 96 to 117. Antiserum used to precipitate M protein was a mouse monoclonal antibody raised against purified M protein. Faeberg et al., "Strain variation and nuclear association of 20 NDV Matrix protein" *J. Virol.* 62:586-593 (1988). Immune complexes (ICs) were adsorbed to Protein A (Pansorbin Cells, CALBIOCHEM) for 2 hours at 4° C., pelleted, and then washed three times in immunoprecipitation (IP) wash buffer (phosphate buffer saline (PBS) containing 0.5% 9 Tween-20 and 0.4% sodium dodecyl sulfate (SDS). ICs were resuspended in SDS-polyacrylamide gel electrophoresis sample buffer (125 mM Tris-HCl [pH 6.8], 2% SDS, 10% glycerol, 0.4% Bromphenol blue) with 1 M J3 mercaptoethanol (BME) and boiled.

Proteins were separated in 8% polyacrylamide-SDS gel and detected by autoradiography. Quantification of resulting autoradiographs was accomplished using a Fluor-STM MultiImager (BioRad).

Example 5

High Efficiency VLP Release

Figure 1B:
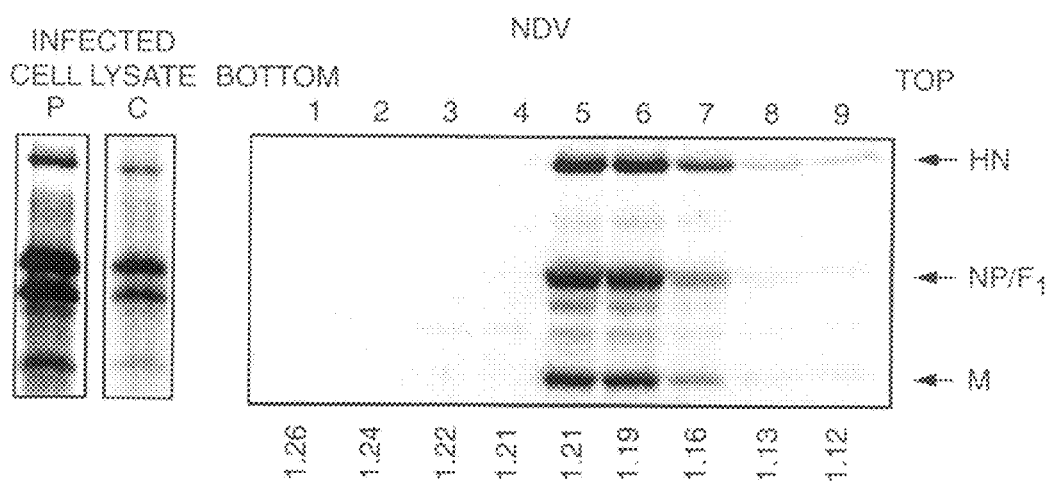
Figure 1C:
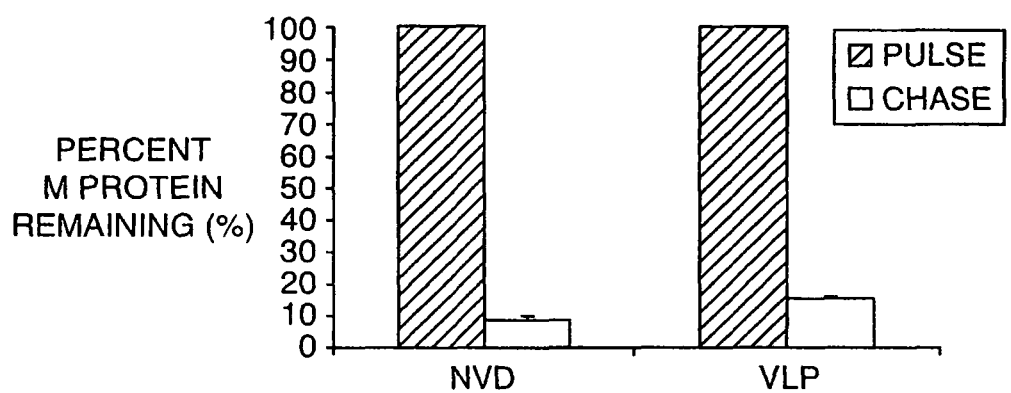

Co-expression of NP, M, F and HN proteins resulted in the release of VLPs with a density of 1.19 to 1.16 g/cc (FIG. 1, panel A). Virus particles purified in parallel from NDV, strain AV, infected cells had a density of 1.21 to 1.19 g/cc (FIG. 1, panel B). Although it is not necessary to understand the mechanism of an invention, it is believed that the slightly lighter density of VLPs compared to authentic virus is likely due to the absence of the virion RNA within the VLPs. The efficiencies of VLP and virus release were calculated as the percentage of M protein remaining in the cell extracts after the chase relative to the amount of protein in the pulse. The loss of M protein from cells in the chase portion of the experiment is due to release from cells as VLPs or virions. By this criterion, the efficiency of VLP release was 85%, while the efficiency of NDV release was 92% (FIG. 1, panel C). The results show that release of VLPs is almost as efficient as release of virions.

These results demonstrate that NDV VLPs are efficiently assembled and released from avian cells expressing the four major structural proteins. In one embodiment, M protein is sufficient for VLP release. Minimum protein requirements for VLP formation, were determined by individually assessing the capability of each protein to direct particle release. Cells expressing each of the viral proteins individually were radioactively labeled in a pulse-chase protocol and VLPs were isolated as described above.

Example 6

M Protein Dependent VLP Release

Figure 2A:
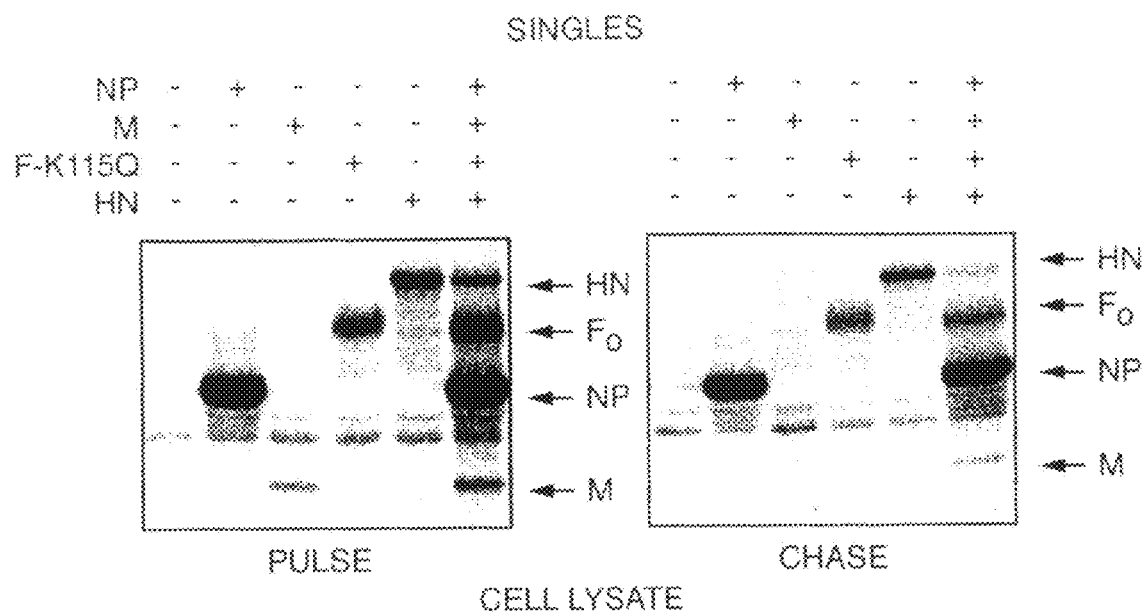
Figure 2B:
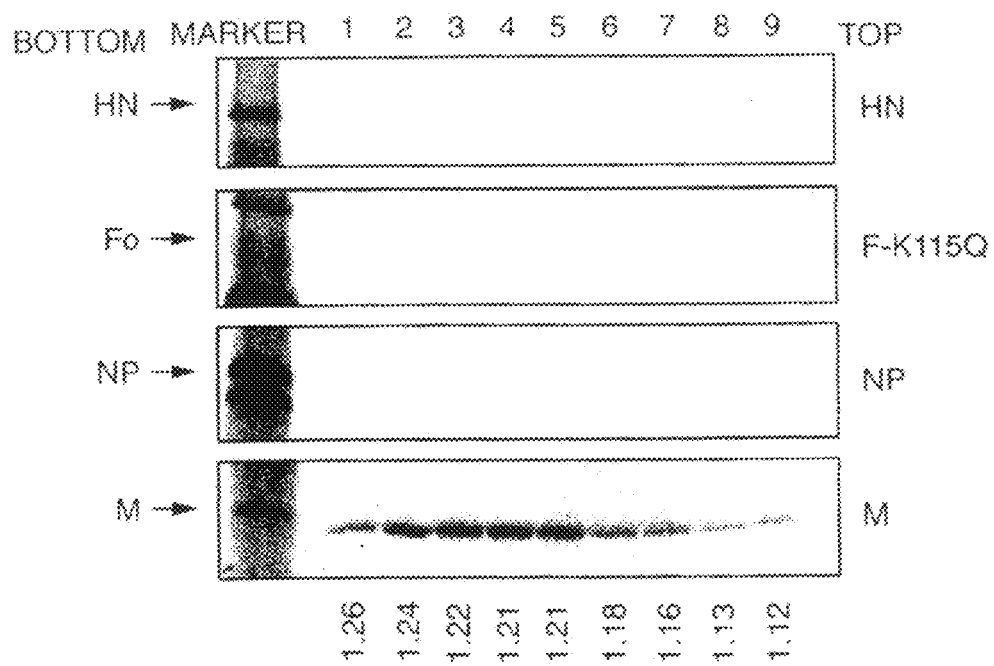
Figure 2C:
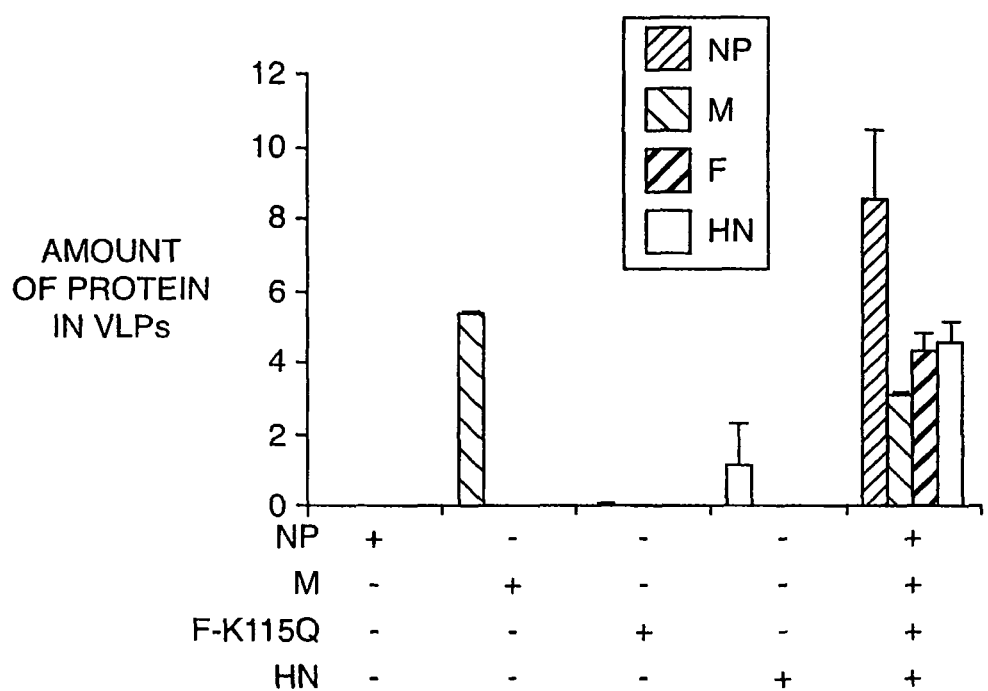

VLPs are released only from cells expressing the M protein. FIG. 2, Panel B. Almost no M protein is detectable in cell extracts after the 8 hour chase. FIG. 2A, right panel. Although it is not necessary to understand the mechanism of an invention, it is believed that this indicates that much of the pulse-labeled protein was released from cells. It is further believed that by comparing the levels of M protein in the pulse labeled extract and the chase extract, the efficiency of release was calculated to be 90%.

In contrast, most of the pulse labeled NP, F and HN proteins remained in extracts after the chase (FIG. 2A). Significant amounts of VLPs were also not detected in the corresponding cell supernatant (FIG. 2, panel B) although there was a trace of very light density material released from HN protein expressing cells. FIG. 2, panel C, shows the quantification of VLPs produced from cells expressing each protein individually. Interestingly, the amount of M protein-containing particles from cells expressing M protein alone was greater than when all four structural proteins were expressed. However, the M protein-only VLPs had a very heterogeneous density, with values ranging from 1.23 to 1.12 g/cc (FIG. 2, panel B). These results reveal that M protein is sufficient for the release of particles.

Example 7

M Protein Dependent VLP Release: Pair Wise Combinations

Figures 3A, 3B:
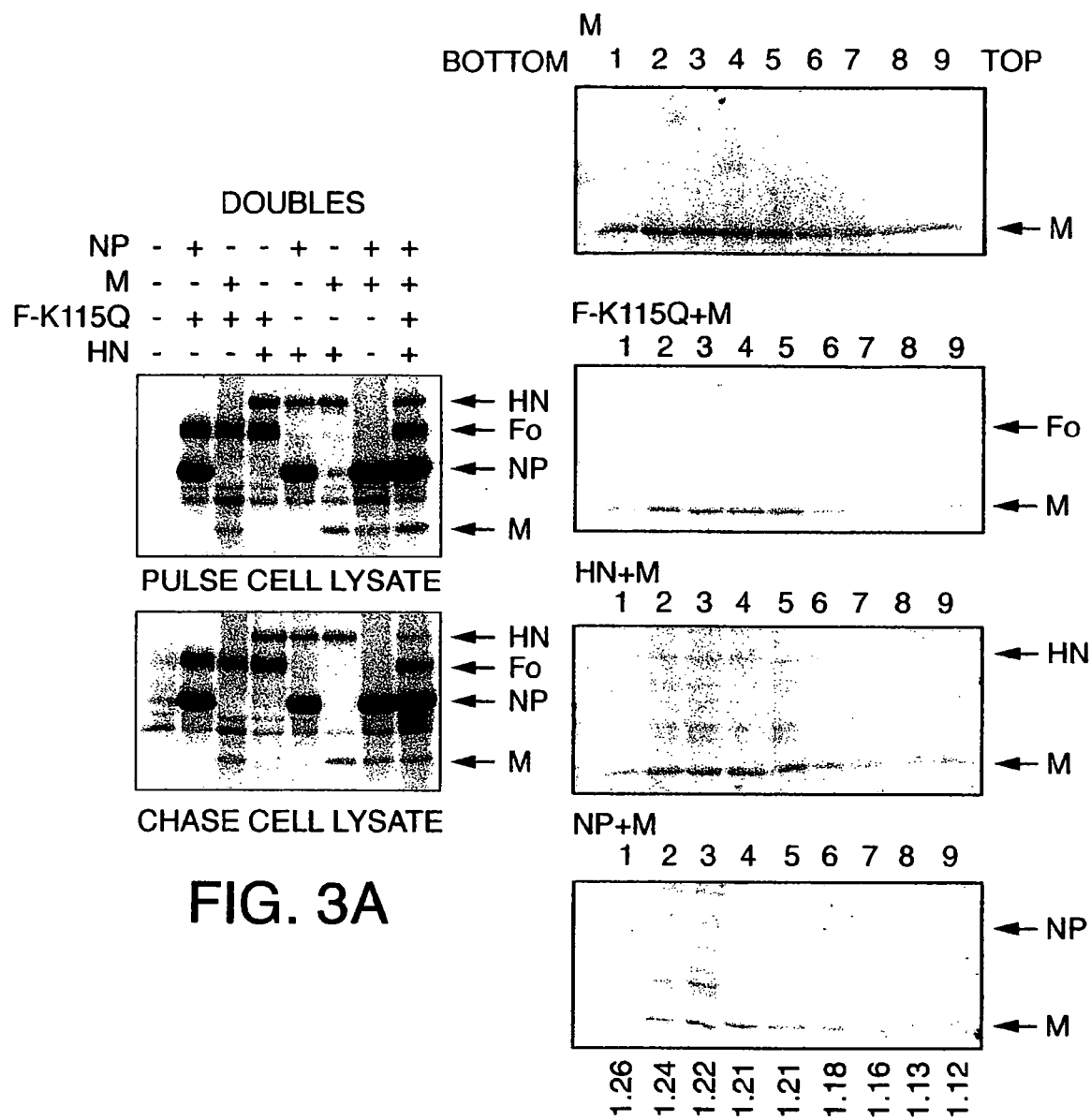
Figure 3C:
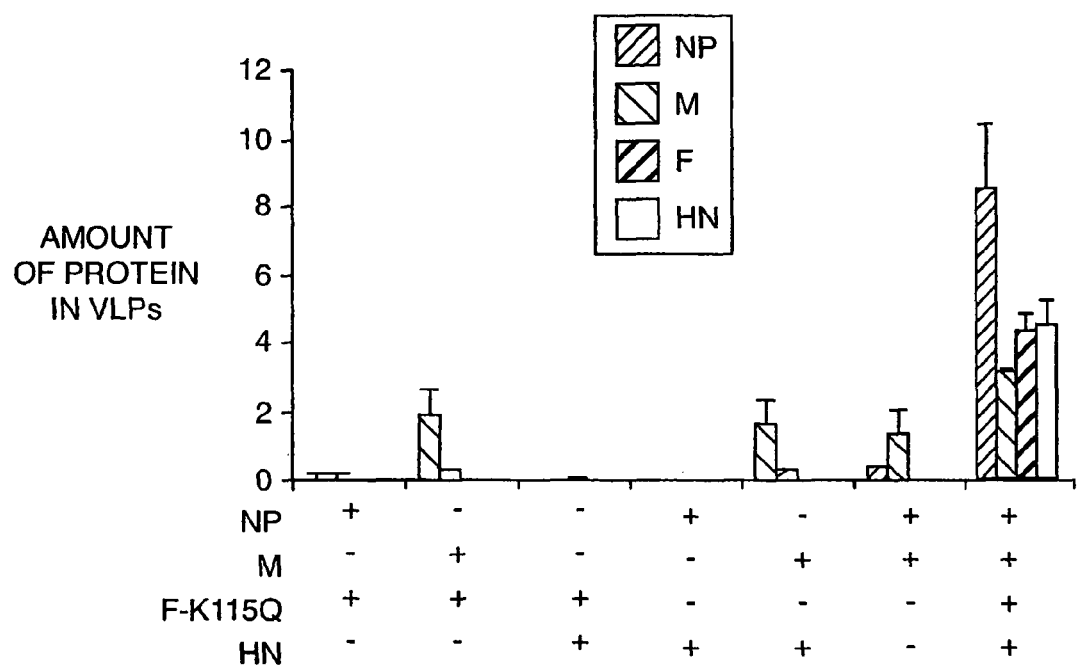

As shown in Example 6, M protein is required for VLP release. To determine the contribution of NP, F or HN proteins to M protein-driven VLP formation, VLPs from cells expressing all possible combinations of two proteins were isolated and characterized as described above. Cells expressing any combination of proteins without M protein did not release VLPs (FIG. 3; panel C). Furthermore, in the absence of M protein, NP, F and HN proteins expressed in pair wise combinations were retained in cell extracts after the 8 hour chase (FIG. 3A). This finding suggests that M protein is required for particle release. Pair wise expression of NP, F, or HN proteins with M protein resulted in the release of VLPs containing both proteins (FIG. 3, panel B). Intriguingly, however, there was only trace amounts of NP, F or HN proteins and M protein was the predominant protein in the VLPs (FIG. 3, panel B).

The distribution of NP, F, or HN proteins in the gradients was identical to that of M protein (FIG. 3, panel B). In addition, the VLP densities were very heterogeneous and were much like that of M protein-only VLPs. Surprisingly also, the amount of M protein containing VLPs was significantly decreased (by about 2 to 2.5 fold) upon co-expression of M protein with either NP, F, or HN proteins (FIG. 3, panel C). These results suggest that NP, F, or HN proteins can individually suppress M protein-driven VLP release.

Example 8

M Protein Dependent VLP Protein Incorporation

Figures 4A, 4B:
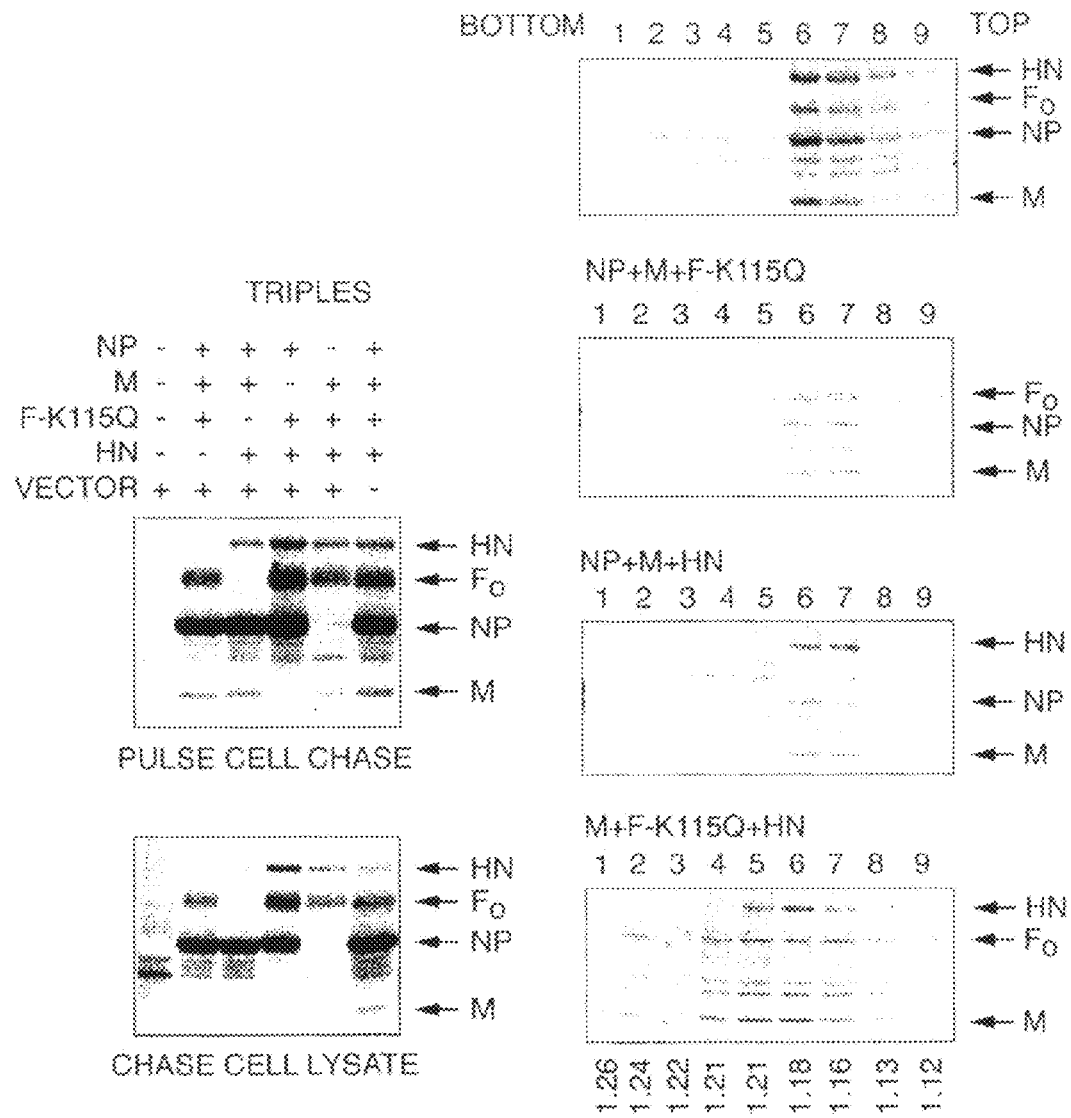
Figure 4C:
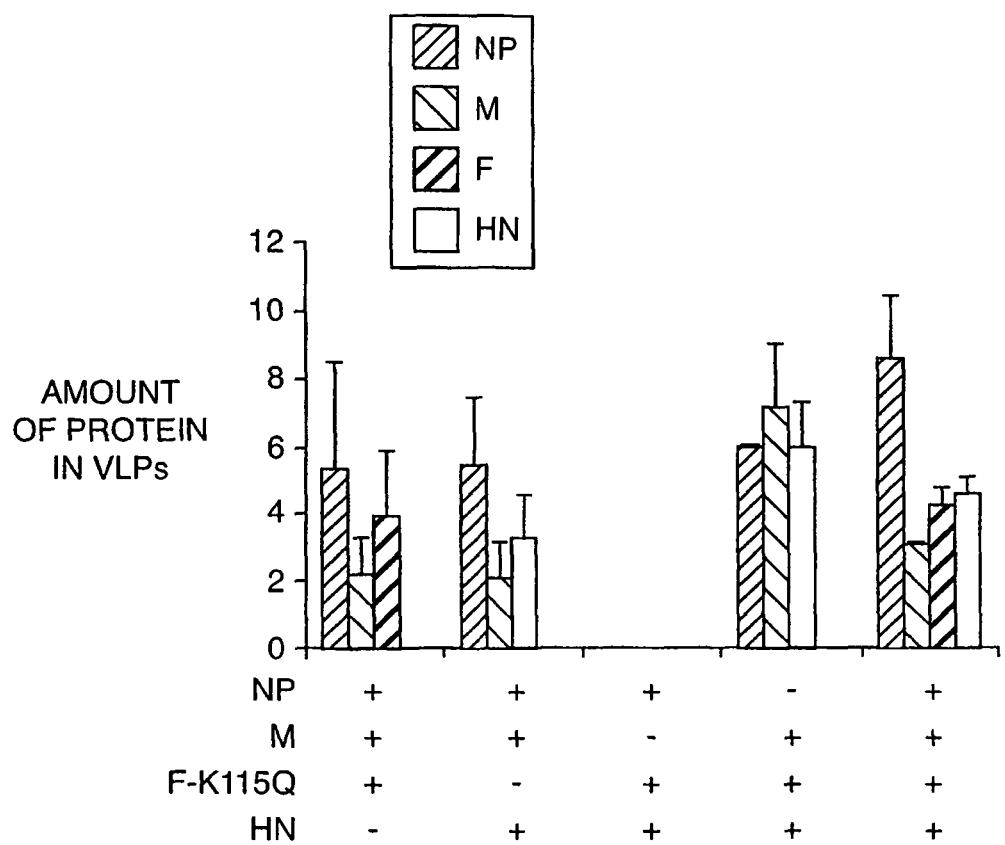
Figures 4D, 4E:
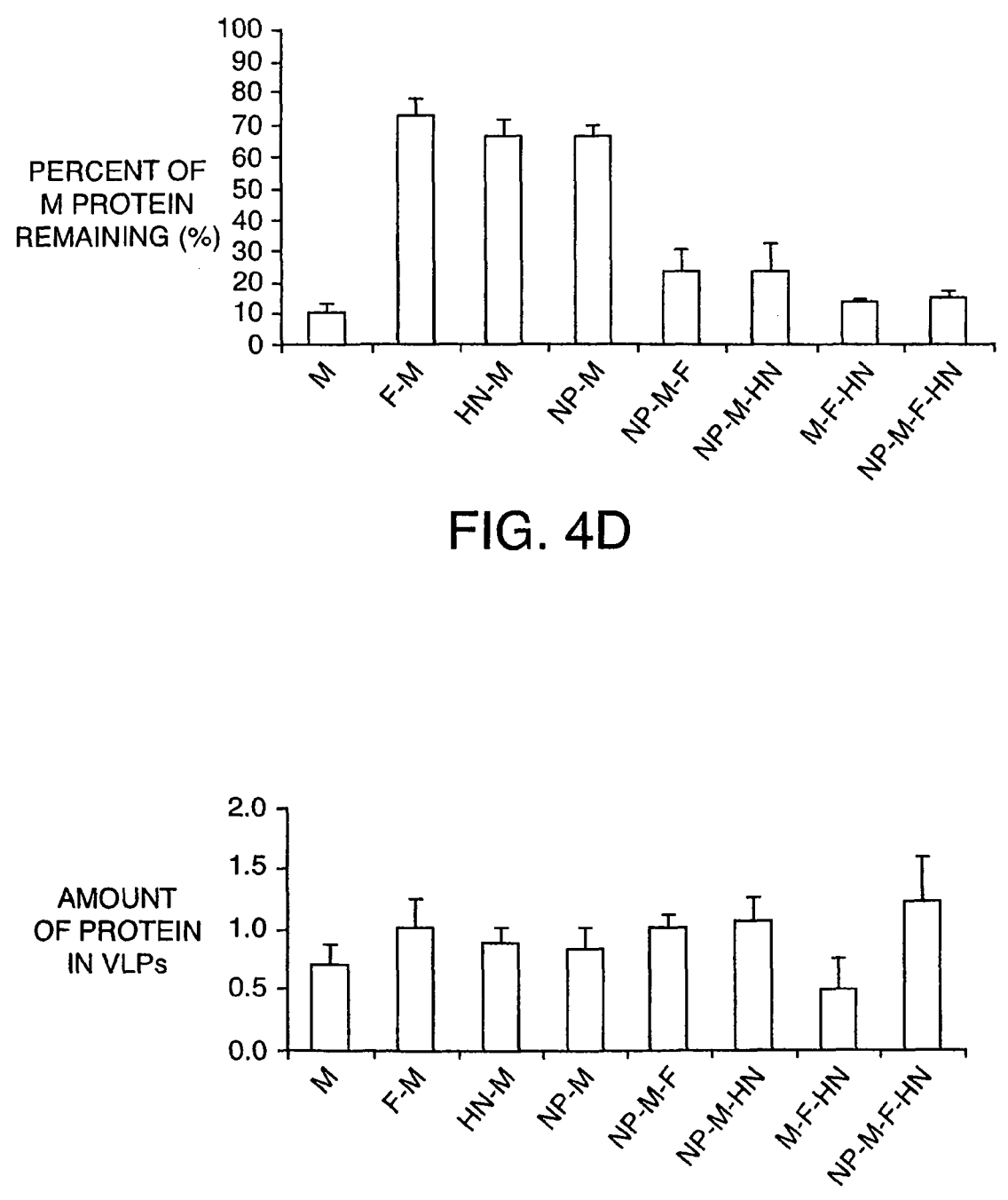
Figure 5A:
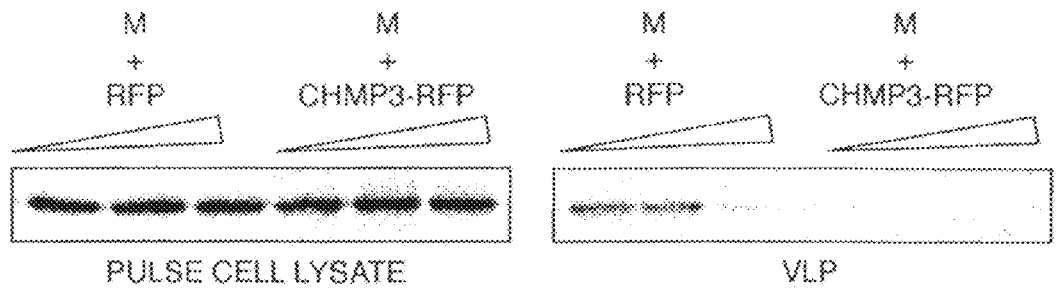
Figure 5B:
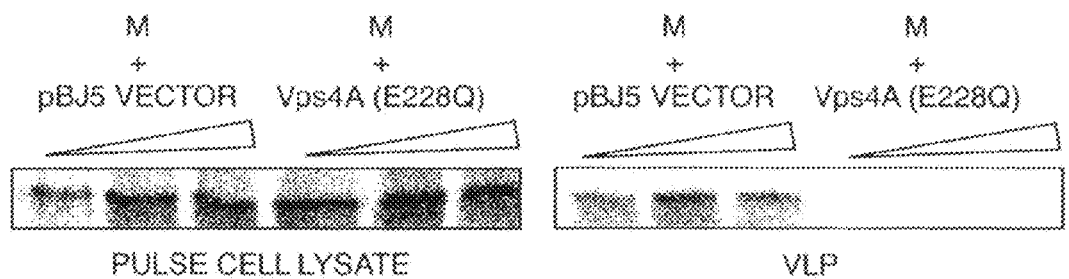
Figure 5C:
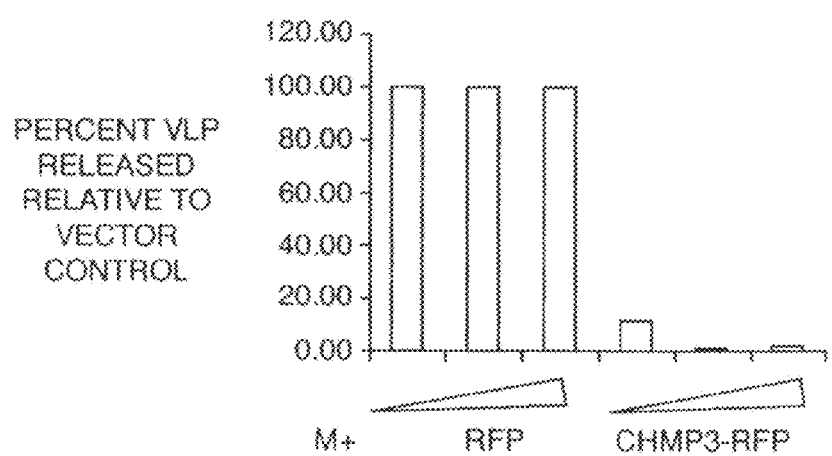
Figure 5D:
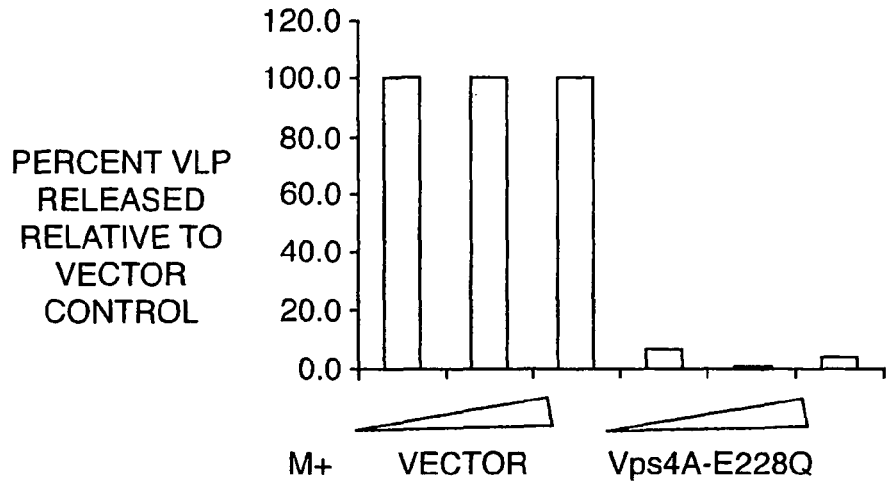
Figure 5E:
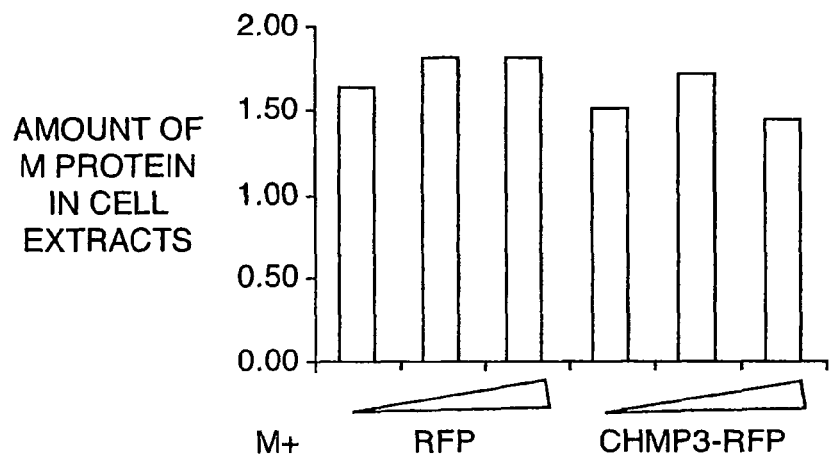
Figure 5F:
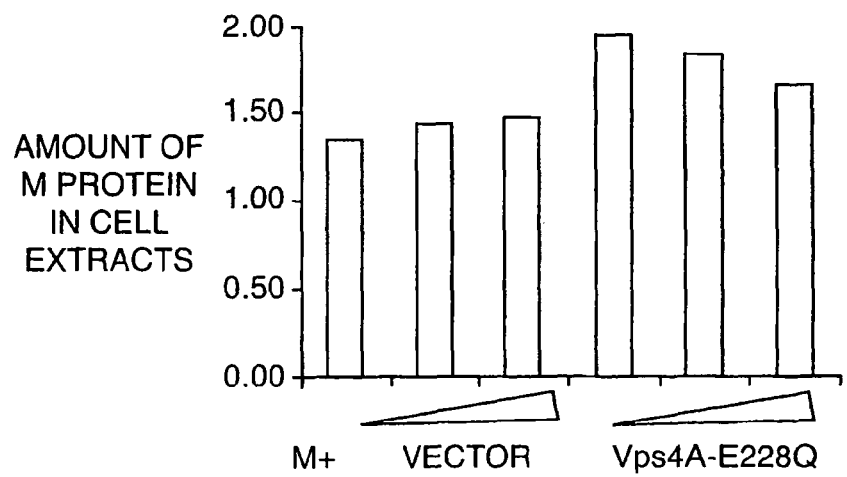
Figure 6:
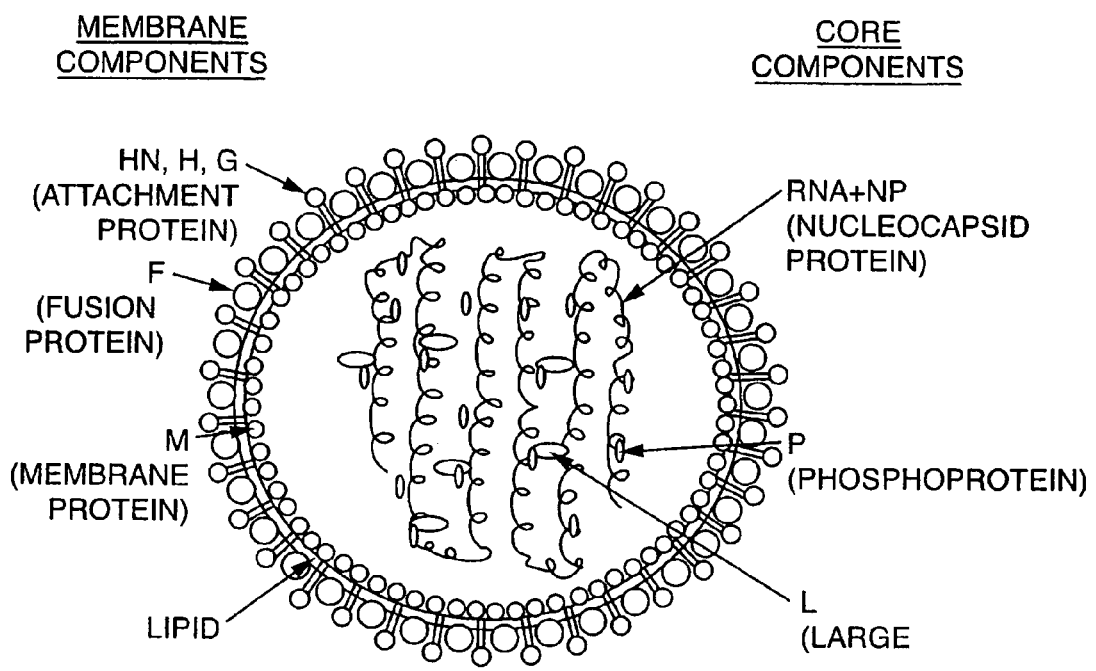
Figure 7:
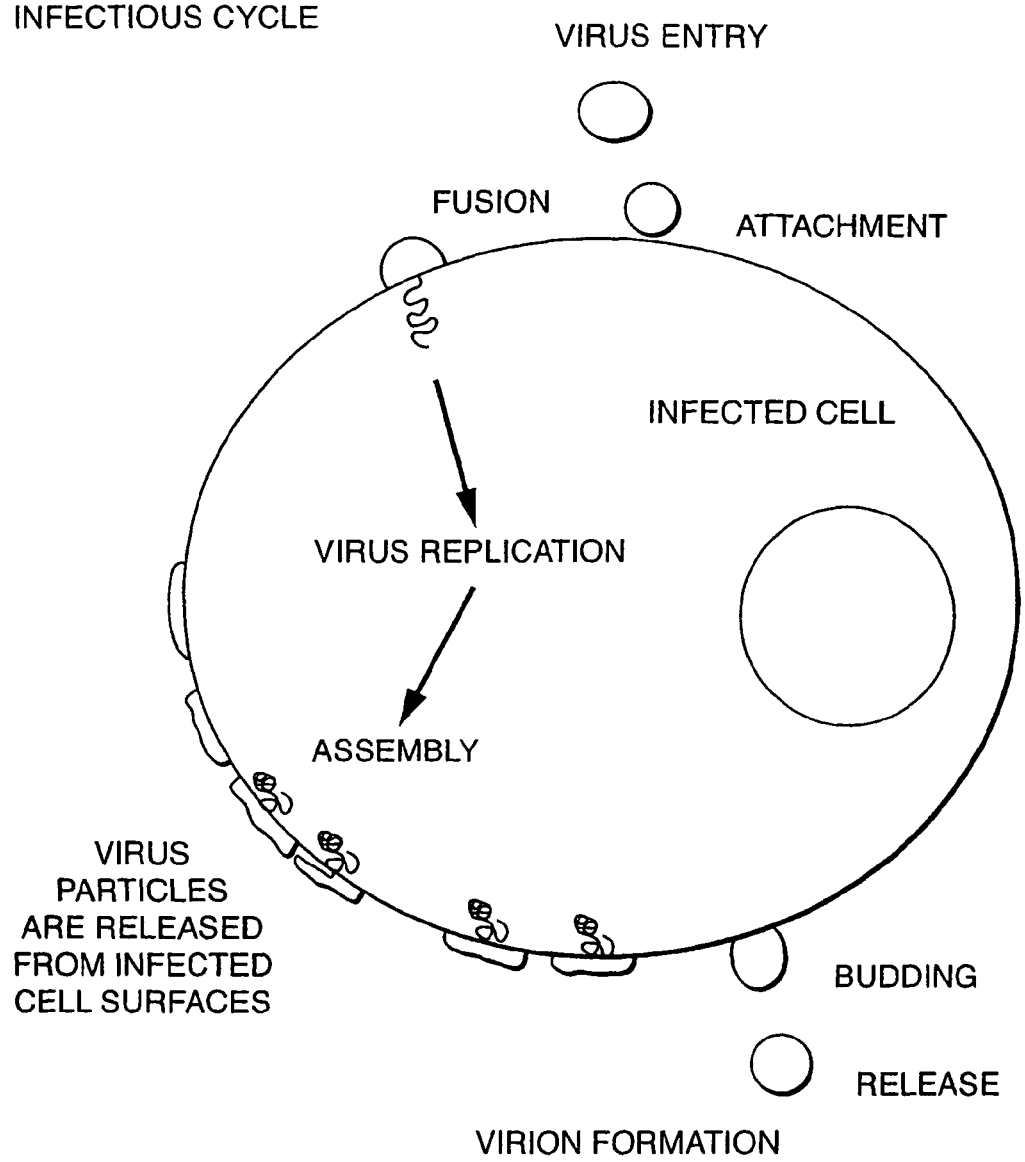
Figure 13A:
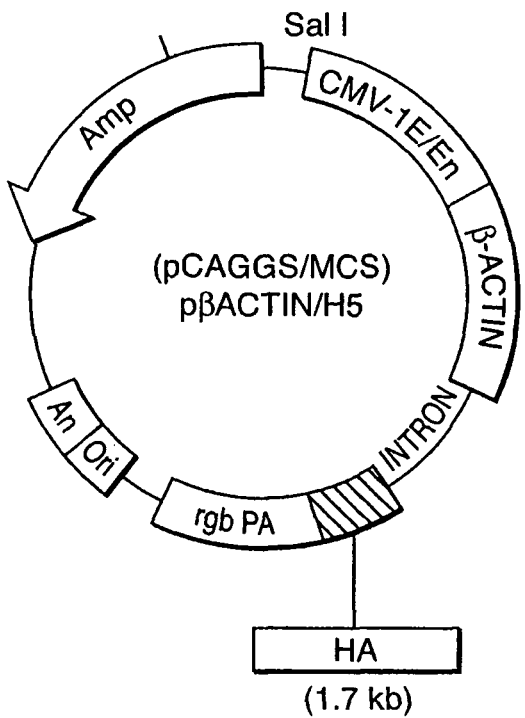
Figure 13B:
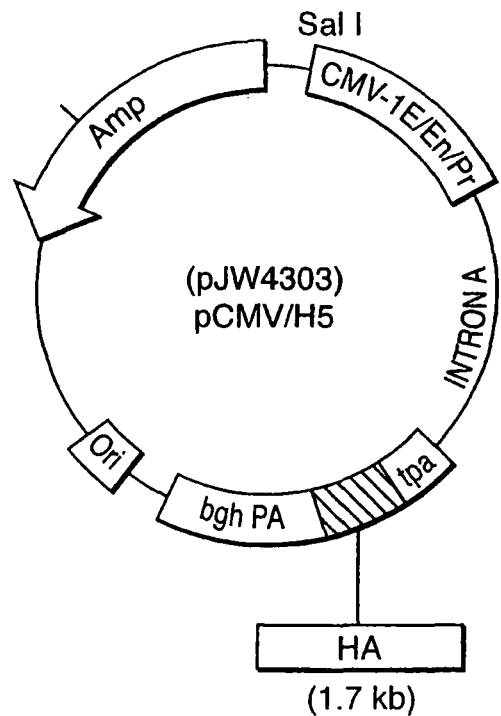

Efficient incorporation of other viral proteins into VLPs requires the expression of M protein and at least two of the other proteins. To examine the effects of expression of three viral proteins on particle release, cells were transfected with all possible combinations of three cDNAs. Again, VLPs were only released from cells expressing M protein. Expression of NP, F, and HN proteins without the M protein did not result in the release of any particles (FIG. 4, panel C). This finding further strengthens our conclusion that the M protein is required for release of VLPs.

In contrast to the expression of a single glycoprotein with the M protein, co-expression of both F and HN glycoproteins with M protein resulted in significantly increased incorporation of both glycoproteins into VLPs (FIG. 4, panels B and C). The F and HN proteins were detected in the same gradient fractions as M protein. Furthermore, the densities of the VLPs were more homogenous compared to those generated from cells expressing M protein alone (compare FIG. 4, panel B and FIG. 2, panel B) or M protein with a single glycoprotein. These results indicate that expression of both F and LIN proteins with M protein is necessary for efficient incorporation of either glycoprotein into particles.

Expression of M protein with NP and either F or HN protein resulted in increased incorporation of NP as well as the glycoprotein into VLPs (FIG. 4, panels B and C). The distribution of NP protein-containing particles in the gradient was similar to that of VLPs released from cells expressing all four structural proteins (compare FIG. 1, panel A and FIG. 4, panel B). Importantly, the densities of these particles were more homogenous compared to particles released from cells expressing M alone, and were analogous to the density of the authentic virus or complete VLPs (compare FIG. 4, panel B, and FIG. 1, panel B). Overall, these results indicate that M protein is necessary and sufficient for particle release and that expression of M protein with at least two other proteins is required for efficient incorporation of other proteins into VLPs.

Example 9

VLP Release Inhibition

Host cell VPS pathway is involved in VLP formation and release. Previous studies have implicated the VPS pathway in budding of other enveloped RNA viruses. Demirov et al., "Retrovirus budding" *Virus Res* 106:87-102 (2004); Pomillos et al., "Mechanisms of enveloped RNA virus budding" *Trends Cell Biol.* 12:569-79 (2002); and Morita et al., "Retrovirus budding" *Annu Rev Cell Dev Biol.* 20:395-425 (2004). This pathway might be involved in M protein-driven VLP release because CHMP3 is a subunit of the ESCRT III complex. von Schwedler et al., "The protein network of HIV budding" *Cell* 4:701-13 (2003).

Fusion of CHMP3 with RFP transforms it into a dominant-negative protein which inhibits HIV-1 gag VLP release. Strack et al., "PIP1/ALIX is a binding partner for HIV-1 p6 and EIAV p9 functioning in virus budding" *Cell* 114:689-699 (2003). Simultaneous expression of the M protein with CHMP3-RFP resulted in 98.5% inhibition of VLP release (FIG. 5, panels A and C). Expression of another dominant-negative component of the VPS pathway, Vps4A-E228Q with M protein, yielded the same result, with 96.2% inhibition (FIG. 5, panels B and D). Expression of both dominant-negative CHMP3 and Vps4A did not suppress the expression of M protein (FIG. 5, panels E and F). Thus an intact host cell VPS pathway is essential for M protein VLP release.

Example 10

Cell Type Dependent Effects on Virus and VLP Release

This example provides exemplary data showing that VLP release is dependent upon the host cell type. Host cell type affects basic VLP release mechanisms as well as overall VLP release efficiencies.

Basic Release Mechanisms

VLP release from avian cells (ELL-0) was compared with VLP release from primate cells (COS-7 cells). To compare virus particle release from these cells, equal numbers of avian cells and COS-7 cells were infected with NDV at an MOI=5. The cells were radioactively labeled in a pulse and then subjected to a nonradioactive chase. Virions were harvested from the cell supernatant at various times during the chase and the proteins in the virus particles resolved by polyacrylamide gel electrophoresis.

Figure 14A:
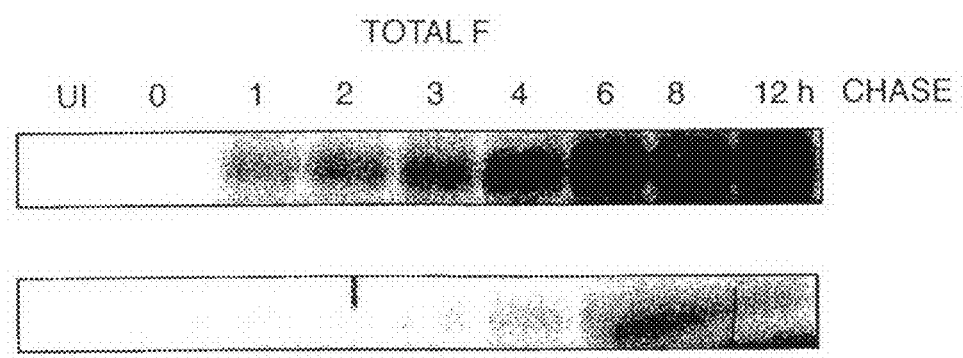
Figure 14B:
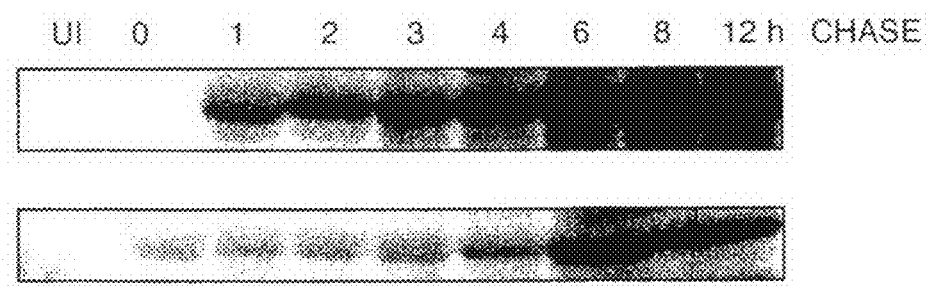
Figure 15A:
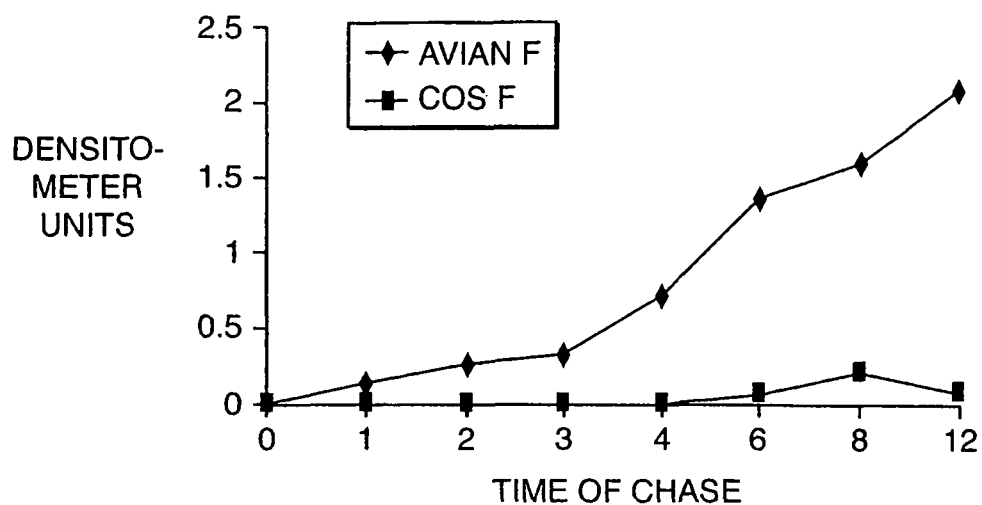
Figure 15B:
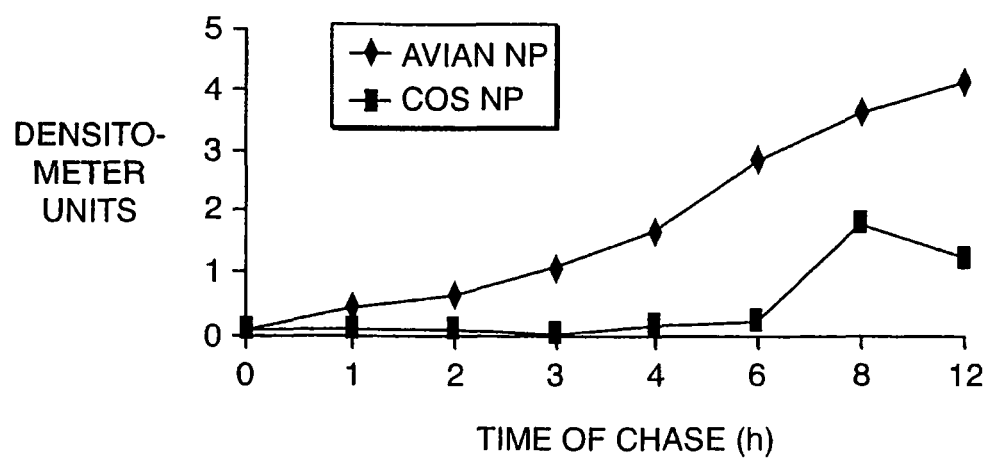

An autoradiograph of the NP and F proteins in virus particles at different times of chase are shown in FIG. 14A and FIG. 14B, respectively (top gel: avian; bottom gel: COS-7). A quantification of the levels of each protein is shown in FIG. 15A and FIG. 15B, respectively. Clearly, the amounts of virus released from avian cells were higher than amounts released from COS-7 cells and the rate of release from avian cells was faster than the rate of release from COS-7 cells. This difference between avian and primate cells was not due to differences in the levels of protein expression in the two cell types. The levels of total viral proteins made during the pulse label were higher in COS-7 cells than avian cells (not shown), a result that suggests that virus entry, replication and translation were at least as efficient in COS-7 as in avian cells.

These data show that the rate of virus particle release is faster in avian cells than primate cells and the amounts of virus released from avian cells are significantly higher than amounts released from primate cells.

Release Efficiencies

To determine if avian cells were also more efficient in the release of VLPs, equal numbers of avian cells and COS-7 cells were transfected with cDNAs encoding the NP, M, HN, and F-K115Q proteins of NDV. Cells were radioactively labeled for four (4) hours (i.e., pulsed) and then subjected to a non-radioactive incubation for eight (8) hours (i.e., chased). VLPs were subsequently isolated from the cell supernatant. VLPs in the supernatants were purified by flotation into sucrose gradients.

Figure 16A:
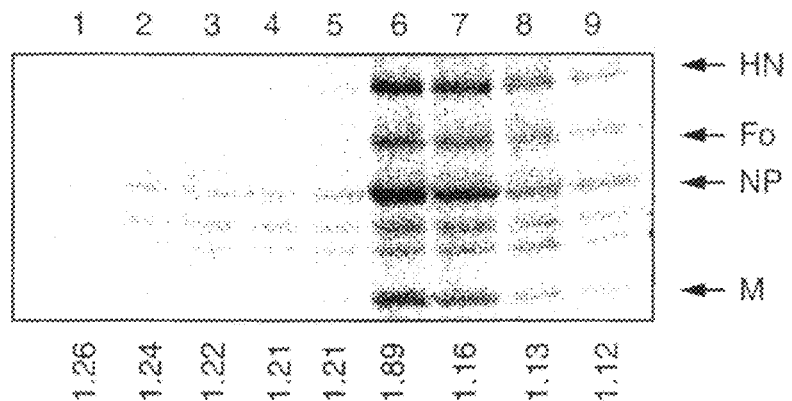
Figure 16B:
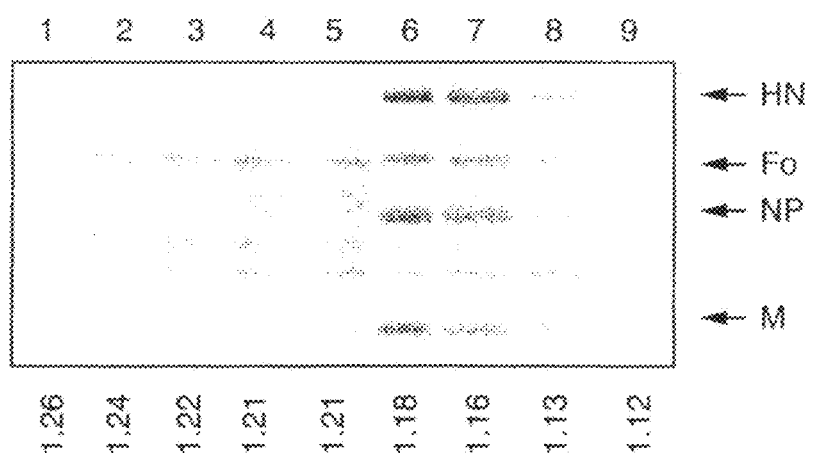
Figure 17A:
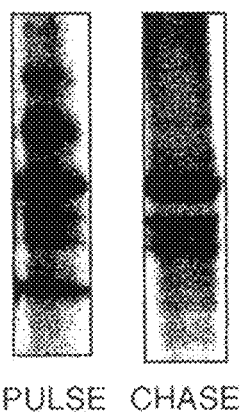
Figure 17B:
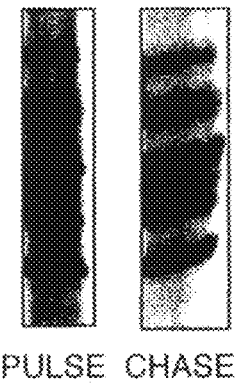
Figure 18A:
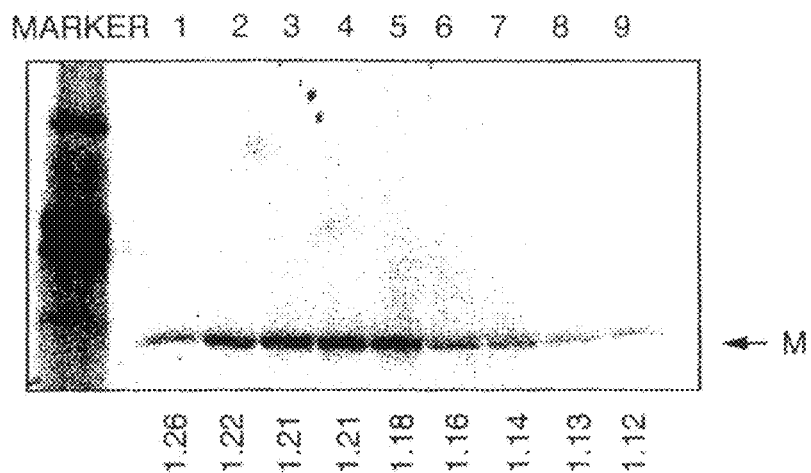
Figure 18B:
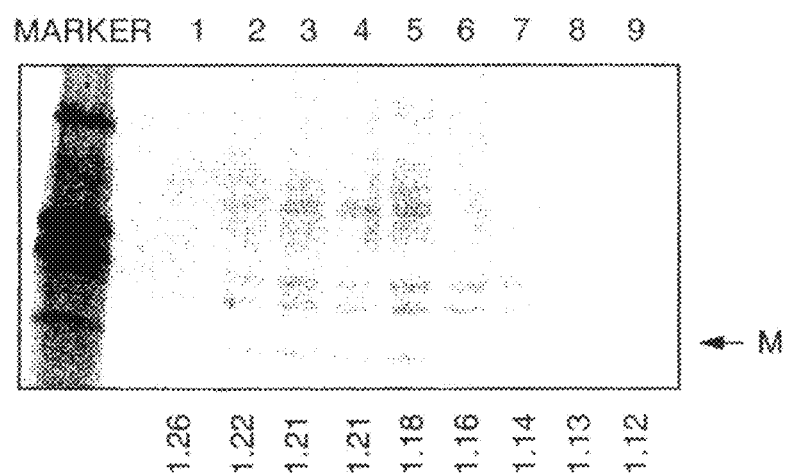
Figure 19A:
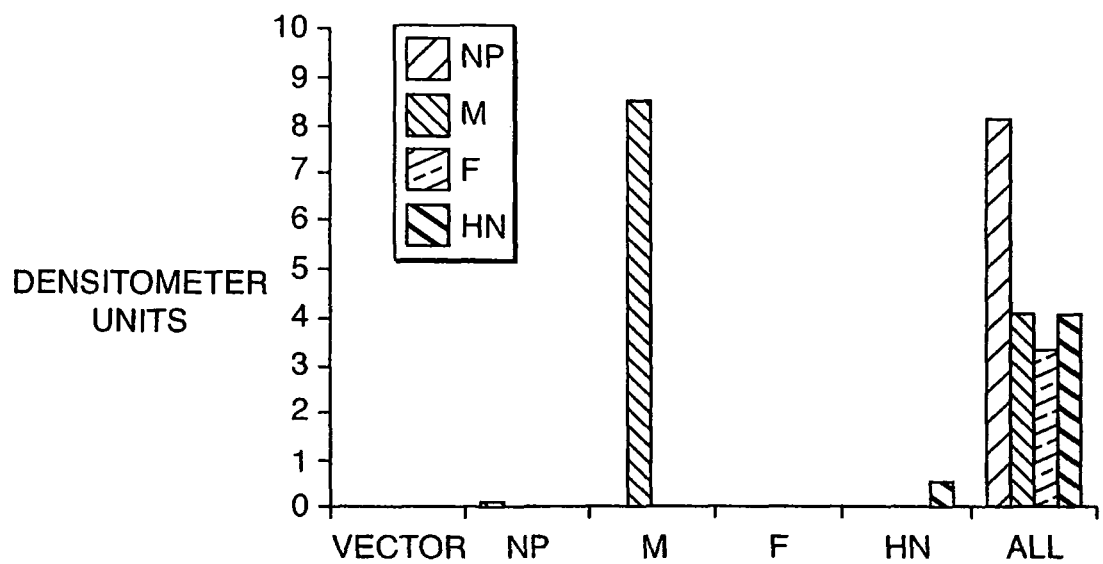
Figure 19B:
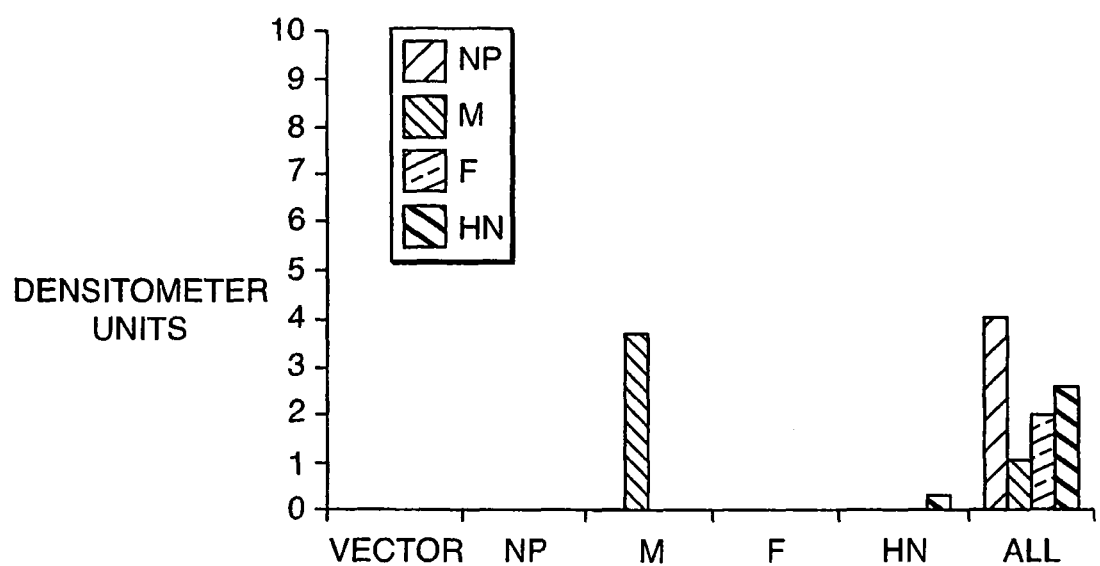

Sucrose gradients were generated that contain VLPs released from avian cells and COS-7 cells, respectively. See FIGS. 16A and 16B, respectively. Clearly, the data show that more VLPs were released from avian cells than from COS-7 cells.

Cell lysate extracts from avian cell and COS-7 cells were prepared after the pulse-label and after the nonradioactive chase. See FIGS. 17A and 17B, respectively. Importantly, the HN, F, and M proteins were no longer present in avian cell extracts after the nonradioactive chase. This observation is consistent with a more efficient release from avian cells and/or incorporation into VLPs. Conversely, significant levels of these viral proteins remained in the COS-7 cell extracts. This observation is consistent with viral protein retention in COS-7 cells and a lower release of the viral proteins into particles. Clearly, the data demonstrate that VLP release is more efficient from avian cells than from COS-7 cells.

Example 11

Comparison Of Specific Viral Protein-Induced VLP Release

This example demonstrates that VLPs are also more efficiently released from avian cells when transfected with NDV containing only an M protein.

VLP particle release was determined from cells transfected with only M protein cDNA as described above. A sucrose density gradient purification of M protein VLPs were generated from both avian and COS-7 primate cells. See FIG. 18A and FIG. 18 B, respectively. Clearly, the amounts of VLP M proteins released from avian cells were significantly higher, and therefore more efficient, than VLP M proteins released from primate cells.

Further, equal numbers of cells were transfected with either NP protein cDNA, M protein cDNA, F-K115Q protein cDNA, or HN protein cDNA alone. Alternatively, the experiment used cells transfected with a vector having all four (4) viral protein cDNAs in combination. VLPs were then prepared as described above. A sucrose gradient purification was generated for each transfection and particle release was determined by densitometry. When the various viral protein cDNAs were transfected individually, only M protein resulted in any VLP viral protein release (i.e., only M protein). When a cell was transfected with all four proteins, VLP viral protein release contained all four proteins. In both cases, released VLPs contained greater amounts of viral proteins in avian cells versus COS-7 cells. See FIG. 19A and FIG. 19B, respectively. Clearly, release efficiency of both M protein VLPs and complete VLPs is better from avian cells than COS-7 cells.

Example 12

Generation of Antibodies To VLP Viral Vaccines

I. Monoclonal Antibodies

Balb/c mice are immunized with multiple I.P. inoculations of a KLH conjugated NDV viral peptide. Splenocytes from immunized animals are then fused with the mouse myeloma AG8 using standard protocols. Wunderlich et al., *J. Immunol. Methods* 147:1-11 (1992). Supernatants from resultant hybridomas are then screened for immunoreactivity to an ovalbumin-coupled NDV viral peptide using standard ELISA protocols known in the art. Hybridomas positive for the expression of immunoreactive MAbs are cloned at least twice by limiting dilution and MAb isotype analysis performed. Purified MAb IgG will be prepared from ascites fluid using protein-A affinity chromatography. After fusion, screening will show a plurality of positive parental signals, from which monoclonal antibody producing clones may be prepared.

Immunoprecipitation/Scintillation Assay for Hybridoma Screening

To develop and screen for monoclonal antibodies which recognize the VLP viral protein in solution rather, than when attached to a solid phase, an assay will be developed in which immunoprecipitation of an $^{35}$ S-methionine-labeled in vitro-translated VLP viral protein is measured. A standard amount of in vitro translated VLP viral protein is allowed to form antibody/antigen complexes in a solution which can be optimized for ionic strength, pH, and detergent composition. After the immune complexes are precipitated with Protein G (Omnisorb cells) and washed extensively, bound radioactivity is counted in a liquid scintillation counter; background is subtracted and the efficiency of precipitation calculated. This Immunoprecipitation/Scintillation assay (IPSA) allows for both the rapid identification and characterization of antibodies, and will be used to test a variety of monoclonal VLP viral protein antibodies. The assay is applicable, in general, to monoclonal hybridoma supernatants as well as polyclonal sera to identify antibodies which can be used for immunoprecipitations.

Briefly, approximately $1.5 \times 10^5$ DPMs of $^{35}$S-methionine-labeled in vitro-translated VLP viral proteins are added to 10 µl of a 10× immunoprecipitation buffer (150 mM NaCl, 10% NP-40, 5% deoxycholic acid, 1% SDS, 500 mM Tris pH 8). To this, 90 µl of monoclonal cell supernatant from the monoclonal fusion of interest is added and allowed to react for 2 hrs at 4° C. After 2 hrs, 40 µl of a 10% solution of Omnisorb cells (Calbiochem) equilibrated in 1× immunoprecipitation buffer (RIPA buffer; 150 mM NaCl, 1% NP-40, 0.5% deoxycholic acid, 0.1% SDS, 50 mM Tris pH8) is added and allowed to react for an additional 2 hrs at 4° C. with rocking. The cells are pelleted by centrifugation for 5 min at 4500 g and 4° C., and washed 3× with 800 µl cold 1× immunoprecipitation buffer. Pellets were quantitatively transferred to scintillation vials and counted in a Beckman LS6000 scintillation counter in the Auto DPM mode. The percentage of VLP viral protein immunoprecipitated may then be calculated.

Characterization of VLP Viral Protein MAbs

To further characterize a best cell line, a competition immunoprecipitation/scintillation assay (Competition IPSA) may be performed. In this variation, a clone producing monoclonal antibodies to a VLP viral protein was added to an approximate 200 fold molar excess of unlabelled competitor peptide at the same time as labeled in vitro translated VLP viral protein. As expected, peptides to the suspected epitope regions will be compared with peptides that are not suspected of representing the epitope regions. A high percentage of competition in assays containing the suspected epitope regions will verify the VLP viral protein monoclonal antibody binding specificity.

II. Antisera

Antisera used to precipitate viral proteins were a cocktail of anti-NDV antibodies. Antiserum used to precipitate NP was rabbit polyclonal antibody raised against UV inactivated NDV by standard protocols. Antisera used to precipitate F protein were raised against glutathione S-transferase (GST) fusion proteins that contained amino acid sequences 130 to 173 (anti-HR1) (McGinnes et al., "Newcastle disease virus HN protein alters the conformation of the F protein at cell surfaces" *J. Virol.* 76:12622-12633 (2002).), 470 to 500 (anti-HR2) (Dolganiuc et al., "Role of the cytoplasmic domain of the Newcastle disease virus fusion protein in association with lipid rafts" *J Virol* 77:12968-12979 (2003)), or 96 to 117 (anti-$F_2$-96). Antiserum used to precipitate HN protein was raised against HN protein sequences from amino acid 96 to 117 (anti-A) (McGinnes et al., "Role of carbohydrate processing and calnexin binding in the folding and activity of the HN protein of Newcastle disease virus" *Virus Res* 53:175-185 (1998)). Antiserum used to precipitate M protein was a mouse monoclonal antibody raised against purified M protein (Faeberg et al., "Strain variation and nuclear association of NDV Matrix protein" *J. Virol.* 62:586-593 (1988)). Antibody used to precipitate HA-tagged proteins was a mouse monoclonal HA antibody conjugated to agarose beads (Sigma). Secondary antibody used for immunoblotting was a peroxidase conjugated mouse monoclonal anti-HA antibody (Sigma).

Example 13

Construction Of Recombinant Baculovirus Vectors

This example describes a general methodology from the construction of recombinant baculovirus vectors.

Figure 28:
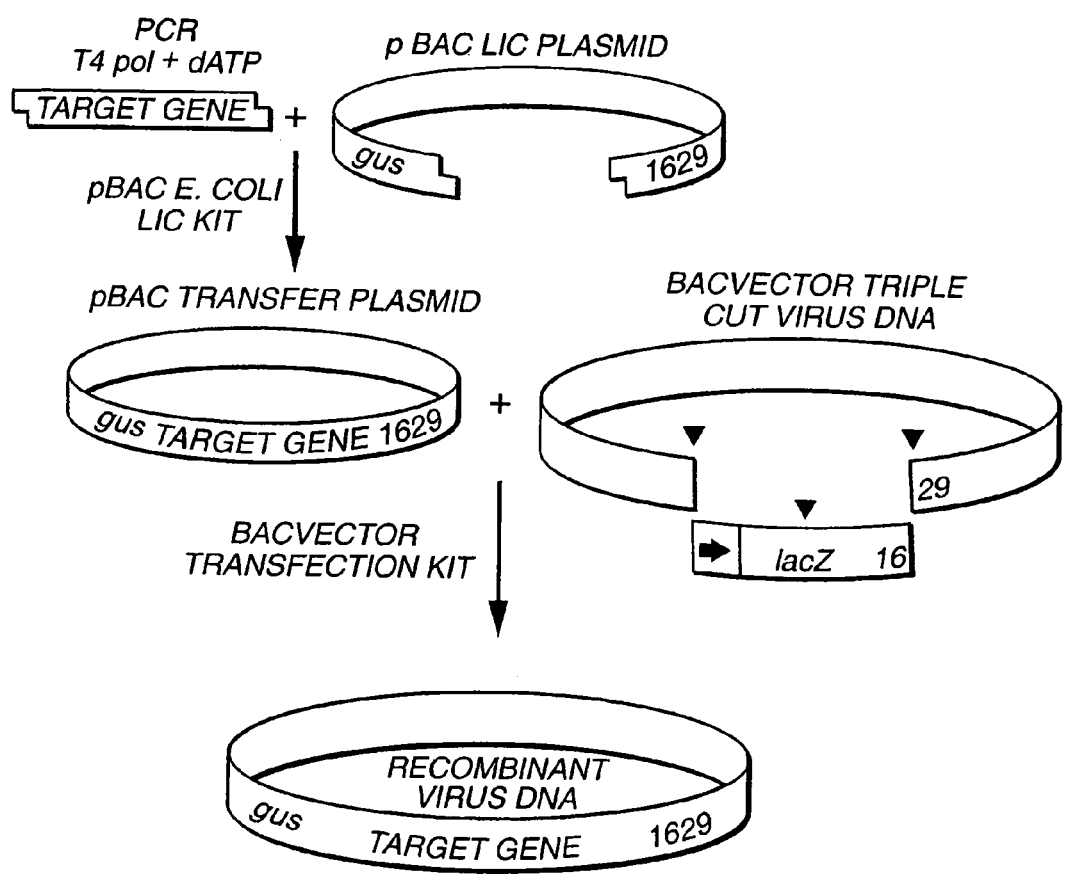
FIG. 28 illustrates one method of constructing baculovirus recombinant DNA.

A general scheme for constructing baculovirus recombinants is shown in FIG. 28. As a first step, the target gene (i.e., for example, an NDV particle protein), shown as a PCR-derived DNA, is cloned downstream of a copy of an AcNPV promoter in a suitable plasmid transfer vector (i.e., for example, pBAC4x-1). The transfer vector has upstream and downstream segments of baculovirus DNA flanking the promoter and target gene.

A selected clone of the derived recombinant transfer vector is grown in a bacterial cell culture (i.e., for example, *E. coli*), avian cell culture (i.e., for example, ELL-O), or a human cell culture (i.e., for example, 293T) and the resulting recombinant plasmid DNA is characterized and purified.

In the second step, the purified recombinant transfer plasmid is co-transfected with linearized virus DNA into insect cells (i.e., for example, Sf9) to construct the recombinant baculovirus. The flanking regions of the transfer vector participate in homologous recombination with the virus DNA sequences during virus replication and introduce the target gene into the baculovirus genome at a specific locus (usually polyhedrin or p10, depending on the transfer plasmid).

Following transfection and plaque purification to remove parental virus, a high titer virus stock is prepared from the appropriate recombinant. Once a high titer virus stock is obtained, it is employed to determine the optimal times for target protein expression (depending on the promoter and the properties of the gene product). After these parameters are established, a large scale culture is prepared and used for protein production.

Example 14

Production Of Measles VLP Vaccine

This example presents a protocol that will result in the production of VLP vaccines specific for the measles virus.

Vectors: MV cDNA sequences encoding NP (i.e., for example, SEQ ID NO:42), M (i.e., for example, SEQ ID NO:48), HA (i.e., for example, SEQ ID NO:30), and uncleaved F (i.e., for example, SEQ ID NO:36) proteins will be subcloned into the expression vector pCAGGS to generate pCAGGS-NP, pCAGGS-M, pCAGGS-HA and pCAGGS-F-K111G, respectively. The cDNA encoding the MV F protein will be mutated to eliminate the furin recognition site at amino acid 108-112. The mutation will introduce a glycine in place of lysine at amino acid 111, the position analogous to the K115Q mutation in the NDV F protein. Elimination of cleavage of the F protein will inhibit the ability of the F protein to fuse. Absence of cell-cell fusion in the culture will likely increase the yield of VLPs.

Cell lines: Measles virus is released efficiently from human and primate cell lines but not murine cell lines (Vincent, et al Virology 265: 185). Thus Hela cells (human cervical carcinoma cells), 293 cells (human embryonic kidney cells), VERO cells (African green monkey kidney cells) and COS-7 (primate) cells will be used.

Transfection, infection and metabolic labeling: Transfections of sub confluent cells will be accomplished using Lipofectamine (Invitrogen) as recommended by the manufacturer. The following amounts of plasmid DNA will be used per 35 mm dish: 1.0 µg pCAGGS-NP, 1.0 µg pCAGGS-M, 0.75 µg pCAGGS-F-K111G, and 1.0 µg pCAGGS-HA. A total of 3.75 µg of plasmid DNA per 35 mm plate will be used in all transfection experiments. When only one, two, or three cDNAs are used, the total amount of transfected DNA will be kept constant by adding vector pCAGGS DNA. For each transfection, a mixture of DNA and 5 µl of Lipofectamine in OptiMEM media (Gibco/Invitrogen) will be incubated at room temperature for 45 minutes, and added to cells previously washed with OptiMEM. The cells will be incubated for 5 hours, the Lipofectamine-DNA complexes removed, and 2 ml of supplemented DMEM added. After 36 hours, the medium will be replaced with 0.7 ml DMEM without cysteine and methionine and supplemented with 100 µCi of $^{35}$S-methionine and $^{35}$S-cysteine mixture (NEG-772 EASYTAG™ Express Protein Labeling Mix, $^{35}$S, Perkin Elmer Life Sciences Inc.). After 4 hours of pulse label, one set of transfected plates will be lysed, while in another set the medium will be replaced with 1.0 ml of supplemented DMEM with 0.1 mM cold methionine (Nutritional Biochemicals Corporation). After 8 hours of chase, the cell supernatant will be collected. In addition, the cells will be sonicated to release cell-associated VLPs. The resulting cell supernatants will be combined. The cells will be lysed in 0.5 ml lysis buffer (10 mM NaCl, 1.5 mM MgCl2, 10 mM Tris-HCl pH7.4) containing Triton-DOC (1% Triton, 1% sodium deoxycholate) and 1.25 mg N-ethylmaleimide (NEM). Cells will be harvested with a cell scraper and homogenized by passing through a 26-gauge needle 10 to 15 times.

To determine if the VPS pathway is involved in VLP budding, sub confluent 293T cells will be simultaneously transfected with pCAGGS-M and different concentrations of either pBJ5-Vps4-E228Q-Flag or pDsRed2-N1-CHMP3. Corresponding empty vectors will be used as control. Cells will be incubated for 36 hours and the same pulse-chase protocol was performed as described above.

To generate virus particles for controls, primate or human cells will be infected at an MOI of 5 pfu for 30 hours and labeled with $^{35}$S-methionine and $^{35}$S-cysteine mixture for 4 hours, and chased in nonradioactive medium for 8 hours as described above. Cell supernatant will be harvested and virions purified as described below. Cells will be lysed and homogenized as described above.

Virus and VLP purification: VLPs as well as virions will be purified from cell supernatants in protocols previously developed for virus purification. The cell supernatants will be clarified by centrifugation at 5000 rpm for 5 min at 4° C., overlaid on top of a step gradient consisting of 3.5 ml 20% and 0.5 ml 65% sucrose solutions in TNE buffer (25 mM Tris-HCl pH 7.4, 150 mM NaCl, 5 mM EDTA), and centrifuged at 40,000 rpm for 12 hours at 4° C. using a SW50.1 rotor (Beckman). The interface (containing concentrated particles) will be collected in 0.5 ml, mixed with 2.0 ml of 80% sucrose, and overlaid on top of 1.0 ml 80% sucrose cushion. Additional layers of sucrose (1.0 ml of 50% and 0.5 ml of 10% sucrose) will be layered on top of the sample. The gradient will be centrifuged at 38,000 rpm for 20 h at 4° C. The gradient will be collected from the bottom into one 1 ml fraction and eight 0.5 ml fractions using a polystaltic pump. Densities of each fraction will be determined using a refractometer. VLPs derived from expression of all combinations of proteins will be prepared in a single experiment, thus enabling direct comparison of results.

Immunoprecipitation and polyacrylamide gel electrophoresis: Immunoprecipitation will be accomplished by combining one volume of cell lysate or sucrose gradient fraction with two volumes of TNE buffer. Samples were incubated with MV specific polyclonal antibodies for 16 hours at 4° C. Antiserum used to precipitate NP, F and HA will be rabbit polyclonal antibody raised against UV inactivated MV by standard protocols. Immune complexes (ICs) will be adsorbed to Protein A (Pansorbin Cells, CALBIOCHEM) for 2 hours at 4° C., pelleted, and then washed three times in immunoprecipitation (IP) wash buffer (phosphate buffer saline (PBS) containing 0.5% Tween-20 and 0.4% sodium dodecyl sulfate (SDS)). ICs will be resuspended in SDS-polyacrylamide gel electrophoresis sample buffer (125 mM Tris-HCl, pH 6.8, 2% SDS, 10% glycerol, 0.4% Bromphenol blue) with 1 M β-mercaptoethanol (BME) and boiled. Proteins will be separated on 8% polyacrylamide-SDS gel and subjected to autoradiography. Quantification of resulting autoradiographs will be accomplished using a Fluor-S™ MultiImager (BioRad).

Example 15

Production of Respiratory Syncytial Virus VLP Vaccine

This example presents a protocol that will result in the production of VLP vaccines specific for the respiratory syncytial virus (RSV).

Vectors: RSV cDNA sequences encoding NP (i.e., for example, SEQ ID NO:70), M (i.e., for example, SEQ ID NO:66 or, alternatively, M2-1), G (i.e., for example, SEQ ID NO:54), and an uncleaved F (i.e., for example, SEQ ID NO:60) protein will be subcloned into the expression vector pCAGGS to generate pCAGGS-NP, pCAGGS-M2-1, pCAGGS-G and pCAGGS-F-R108N/R109N, respectively. The cDNA encoding the RSV F protein will be mutated to eliminate one of the two furin recognition sites at amino acids 106-109 and 131-136, as previously reported (Gonzalez-Reyes, et al, PNAS 98: 9859). Elimination of cleavage will inhibit the ability of the F protein to fuse. The absence of cell-cell fusion will likely increase the release of VLPs. A double mutation, R108N/R109N, eliminates one cleavage and inhibits the fusion activity of the protein (Gonzalez-Reyes, et al, PNAS 98: 9859). Additional RSV proteins not found in other paramyxoviruses are NS1, NS2, M2-2, and SH, but all have been shown to be nonessential for virus assembly (reviewed in Collins, et al, Respiratory Syncytial Virus, in Fields Virology, Ed. Knipe, D. and Howley, P. Lippincott Williams and Wilkins, 2001). G protein is also non-essential for assembly but likely contributes to a protective immune response to the virus.

Cell lines: RSV grows efficiently in a variety of cell lines from human and animal sources. However, HEp-2 cells (a Hela cell variant) are the most efficient in production of virus (reviewed in Collins, et al, Respiratory Syncytial Virus, in Fields Virology, Ed. Knipe, D. and Howley, P. Lippincott Williams and Wilkins, 2001), thus these cells will be used. A549 cells (type II alveolar epithelial lung carcinoma cells), also reported to be permissive for RSV, will be used as well.

Transfection infection and metabolic labeling: Transfections of sub confluent cells will be accomplished using Lipofectamine (Invitrogen) as recommended by the manufacturer. The following amounts of plasmid DNA will be used per 35 mm dish: 1.0 µg pCAGGS-NP, 1.0 µg pCAGGS-M2-1, 0.75 µg pCAGGS-F-R108N/R109N, and 1.0 µg pCAGGS-G. A total of 3.75 µg of plasmid DNA per 35 mm plate will be used in all transfection experiments. When only one, two, or three cDNAs are used, the total amount of transfected DNA will be kept constant by adding vector pCAGGS DNA. For each transfection, a mixture of DNA and 5 µl of Lipofectamine in OptiMEM media (Gibco/Invitrogen) will be incubated at room temperature for 45 minutes, and added to cells previously washed with OptiMEM. The cells will be incubated for 5 hours, the Lipofectamine-DNA complexes removed, and 2 ml of supplemented DMEM added. After 36 hours, the medium will be replaced with 0.7 ml DMEM without cysteine and methionine and supplemented with 100 µCi of $^{35}$S-methionine and $^{35}$S-cysteine mixture (NEG-772 EASYTAG™ Express Protein Labeling Mix, $^{35}$S, Perkin Elmer Life Sciences Inc.). After 4 hours of pulse label, one set of transfected plates will be lysed, while in another set the medium will be replaced with 1.0 ml of supplemented DMEM with 0.1 mM cold methionine (Nutritional Biochemicals Corporation). After 8 hours of chase, the medium will be collected. In addition, the cells will sonicated to release cell associated VLPs. The resulting cell supernatants will be combined. The cells will be lysed in 0.5 ml lysis buffer (10 mM NaCl, 1.5 mM MgCl$_2$, 10 mM Tris-HCl, pH 7.4) containing Triton-DOC (1% Triton, 1% sodium deoxycholate) and 1.25 mg N-ethylmaleimide (NEM). Cells will be harvested with a cell scraper and homogenized by passing through a 26-gauge needle 10 to 15 times.

To determine if the VPS pathway is involved in VLP budding, sub confluent HEp-2 cells will be simultaneously transfected with pCAGGS-M2-1 and different concentrations of either pBJ5-Vps4-E228Q-Flag or pDsRed2-N-1-CHMP3. Corresponding empty vectors will be used as control. Cells will be incubated for 36 hours and the same pulse-chase protocol was performed as described above.

To generate virus particles for controls, cells will be infected at an MOI of 10 pfu for 30 hours and labeled with $^{35}$S-methionine and $^{35}$S-cysteine mixture for 4 hours, and chased in nonradioactive medium for 8 hours as described above. Cell supernatant will be harvested and virions purified as described below. Cells will be lysed and homogenized as described above.

Virus and VLP purification: VLPs as well as virions will be purified from cell supernatants in protocols previously developed for virus purification. The cell supernatants will be clarified by centrifugation at 5000 rpm for 5 min at 4° C., overlaid on top of a step gradient consisting of 3.5 ml 20% and 0.5 ml 65% sucrose solutions in TNE buffer (25 mM Tris-HCl pH 7.4, 150 mM NaCl, 5 mM EDTA), and centrifuged at 40,000 rpm for 12 hours at 4° C. using a SW50.1 rotor (Beckman). The interface (containing concentrated particles) will be collected in 0.5 ml, mixed with 2.0 ml of 80% sucrose, and overlaid on top of 1.0 ml 80% sucrose cushion. Additional layers of sucrose (1.0 ml of 50% and 0.5 ml of 10% sucrose) will be layered on top of the sample. The gradient will be centrifuged at 38,000 rpm for 20 h at 4° C. The gradient will be collected from the bottom into one 1 ml fraction and eight 0.5 ml fractions using a polystaltic pump. Densities of each fraction will be determined using a refractometer. VLPs derived from expression of all combinations of proteins will be prepared in a single experiment, thus enabling direct comparison of results.

Immunoprecipitation and polyacrylamide gel electrophoresis: Immunoprecipitation will be accomplished by combining one volume of cell lysate or sucrose gradient fraction with two volumes of TNE buffer. Samples will be incubated with RSV specific polyclonal antibodies for 16 hours at 4° C. Antiserum to be used is commercially available from several sources. Immune complexes (ICs) will be adsorbed to Protein A (Pansorbin Cells, CALBIOCHEM) for 2 hours at 4° C., pelleted, and then washed three times in immunoprecipitation (IP) wash buffer (phosphate buffer saline (PBS) containing 0.5% Tween-20 and 0.4% sodium dodecyl sulfate (SDS)). ICs will be resuspended in SDS-polyacrylamide gel electrophoresis sample buffer (125 mM Tris-HCl, pH 6.8, 2% SDS, 10% glycerol, 0.4% Bromphenol blue) with 1 M β-mercaptoethanol (BME) and boiled. Proteins will be separated on 8% polyacrylamide-SDS gel and subjected to autoradiography. Quantification of resulting autoradiographs will be accomplished using a Fluor-S™ MultiImager (BioRad).

Example 16

Production Of Parainfluenza 3 VLP Vaccine

This example presents a protocol that will result in the production of VLP vaccines specific for the parainfluenza 3 (PIV).

Vectors: PIV3 cDNA sequences encoding NP (i.e., for example, SEQ ID NO:76), M (i.e., for example, SEQ ID NO:80), HN (i.e., for example, SEQ ID NO:84), and an uncleaved F (i.e., for example, SEQ ID NO:78) protein will be subcloned into the expression vector pCAGGS to generate pCAGGS-NP, pCAGGS-M, pCAGGS-HN and pCAGGS-F, respectively. The cDNA encoding the PIV3 F protein will be mutated to eliminate the furin recognition site at amino acid 109. The lysine at amino acid 108 will be changed to glycine. Elimination of cleavage will inhibit the ability of the F protein to fuse. The absence of cell-cell fusion will likely increase the release of VLPs.

Cell lines: PIV 3 grows efficiently in a variety of cell lines from human and primate sources. Thus Hela cells (human cervical carcinoma cells), 293 cells (human embryonic kidney cells), VERO cells (African green monkey kidney cells) and COS-7 (primate) cells will be used. (reviewed in Chanock, et al, Parainfluenza Viruses, in Fields Virology, Ed. Knipe, D. and Howley, P. Lippincott Williams and Wilkins, 2001. LLC-MK2 (rhesus kidney cells) and NCI-H292 (human lung carcinoma) cells will also be used as they have been successfully used to generate virus.

Transfection, infection and metabolic labeling: Transfections of sub confluent cells will be accomplished using Lipofectamine (Invitrogen) as recommended by the manufacturer. The following amounts of plasmid DNA will be used per 35 mm dish: 1.0 μg pCAGGS-NP, 1.0 μg pCAGGS-M, 0.75 μg pCAGGS-F-K108G, and 1.0 μg pCAGGS-HN. A total of 3.75 μg of plasmid DNA per 35 mm plate will be used in all transfection experiments. When only one, two, or three cDNAs are used, the total amount of transfected DNA will be kept constant by adding vector pCAGGS DNA. For each transfection, a mixture of DNA and 5 μl of Lipofectamine in OptiMEM media (Gibco/Invitrogen) will be incubated at room temperature for 45 minutes, and added to cells previously washed with OptiMEM. The cells will be incubated for 5 hours, the Lipofectamine-DNA complexes removed, and 2 ml of supplemented DMEM added. After 36 hours, the medium will be replaced with 0.7 ml DMEM without cysteine and methionine and supplemented with 100 μCi of $^{35}$S-methionine and $^{35}$S-cysteine mixture (NEG-772 EASYTAG™ Express Protein Labeling Mix, $^{35}$S, Perkin Elmer Life Sciences Inc.). After 4 hours of pulse label, one set of transfected plates will be lysed, while in another set the medium will be replaced with 1.0 ml of supplemented DMEM with 0.1 mM cold methionine (Nutritional Biochemicals Corporation). After 8 hours of chase, the cell supernatant will be collected. The cells will be lysed in 0.5 ml lysis buffer (10 mM NaCl, 1.5 mM MgCl$_2$, 10 mM Tris-HCl pH7.4) containing Triton-DOC (1% Triton, 1% sodium deoxycholate) and 1.25 mg N-ethylmaleimide (NEM). Cells will be harvested with a cell scraper and homogenized by passing through a 26-gauge needle 10 to 15 times.

To determine if the VPS pathway is involved in VLP budding, sub confluent HEp-2 cells will be simultaneously transfected with pCAGGS-M and different concentrations of either pBJ5-Vps4-E228Q-Flag or pDsRed2-N1-CHMP3. Corresponding empty vectors will be used as control. Cells will be incubated for 36 hours and the same pulse-chase protocol was performed as described above.

To generate virus particles for controls, cells will be infected at an MOI of 10 pfu for 30 hours and labeled with $^{35}$S-methionine and $^{35}$S-cysteine mixture for 4 hours, and chased in nonradioactive medium for 8 hours as described above. Cell supernatant will be harvested and virions purified as described below. Cells will be lysed and homogenized as described above.

Virus and VLP purification: VLPs as well as virions will be purified from cell supernatants in protocols previously developed for virus purification. The cell supernatants will be clarified by centrifugation at 5000 rpm for 5 min at 4° C., overlaid on top of a step gradient consisting of 3.5 ml 20% and 0.5 ml 65% sucrose solutions in TNE buffer (25 mM Tris-HCl pH 7.4, 150 mM NaCl, 5 mM EDTA), and centrifuged at 40,000 rpm for 12 hours at 4° C. using a SW50.1 rotor (Beckman). The interface (containing concentrated particles) will be collected in 0.5 ml, mixed with 2.0 ml of 80% sucrose, and overlaid on top of 1.0 ml 80% sucrose cushion. Additional layers of sucrose (1.0 ml of 50% and 0.5 ml of 10% sucrose) will be layered on top of the sample. The gradient will be centrifuged at 38,000 rpm for 20 h at 4° C. The gradient will be collected from the bottom into one 1 ml fraction and eight 0.5 ml fractions using a polystaltic pump. Densities of each fraction will be determined using a refractometer. VLPs derived from expression of all combinations of proteins will be prepared in a single experiment, thus enabling direct comparison of results.

Immunoprecipitation and polyacrylamide gel electrophoresis: Immunoprecipitation will be accomplished by combining one volume of cell lysate or sucrose gradient fraction with two volumes of TNE buffer. Samples will be incubated with PIV3 specific polyclonal antibodies for 16 hours at 4° C. Antiserum to be used is commercially available from several sources. Immune complexes (ICs) will be adsorbed to Protein A (Pansorbin Cells, CALBIOCHEM) for 2 hours at 4° C., pelleted, and then washed three times in immunoprecipitation (IP) wash buffer (phosphate buffer saline (PBS) containing 0.5% Tween-20 and 0.4% sodium dodecyl sulfate (SDS)). ICs will be resuspended in SDS-polyacrylamide gel electrophoresis sample buffer (125 mM Tris-HCl, pH 6.8, 2% SDS, 10% glycerol, 0.4% Bromphenol blue) with 1 M β-mercaptoethanol (BME) and boiled. Proteins will be separated on 8% polyacrylamide-SDS gel and subjected to autoradiography. Quantification of resulting autoradiographs will be accomplished using a Fluor-STM MultiImager (BioRad).

Example 17

Site-Specific Mutagenesis of Late Domains

Mutations in the M protein PKSP and YANL sequences at amino acids 216 and 219 and amino acids 232 and 235 were introduced by PCR to yield M-$A_{216}A_{219}$ and M-$A_{232}A_{235}$, respectively. Specific sited-directed mutagenic primers were designed to substitute the proline residues at positions 216 and 219 and tyrosine and leucine residues at positions 232 and 235, respectively, with alanine. Additional mutant M genes were constructed by substituting PTAP or YPDL sequences for YANL at amino acid positions 232 to 235. The entire genes of each M protein mutant DNA were sequenced to verify that no additional mutation was introduced by the mutagenesis protocol. Mutations generated are illustrated in FIG. 70.

Example 18

VLP Release from 293T Cells

This example evaluates the effects on particle release of available dominant negative mutant human VPS proteins and whether human renal epithelial cells (293T) could support the release of NDV VLPs.

VLP particles were released from 293T cells expressing M protein alone (top panel) or 293T cells co-expressing NP, M, F-K115Q and HN proteins (bottom panel). FIG. 67, Panel A. Particles released from 293T cells expressing M protein alone were very heterogeneous with respect to density (FIG. 67, panel A, top panel), very similar to particles released from avian cells expressing M protein alone. In contrast, VLPs released from 293T cells expressing all 4 major structural proteins were more homogenous in density. These particles were slightly less dense (1.18 g/cc) than the authentic virus (1.2 g/cc; (Lamb et al., In: *Paramvxoviridae: The Viruses and Their Replication*, Third edition ed, vol. 1. LippincottWilliams & Wilkins, Philadelphia (2001))) due to absence of genomic RNA.

These combined results show that M protein VLPs and complete VLPs were released from 293T cells. However, the efficiency of release of particles from 293T cells, as measured by the percentage of pulse labeled M protein remaining in cells after a long nonradioactive chase, was lower than VLP release from avian cells (50% vs. 84%, respectively).

Example 19

Dominant Negative VPS Protein Mutants Inhibit Particle Release

This example was designed to determine if inhibition of particle release was due only to over expression of dominant negative VPS proteins.

293T cells were transfected with vector control, wild type CHMP3, wild type Vps4A, wild type AIP1, dominant negative (dn) CHMP3, dn Vps4A, and dn AIP1.

The wild type forms of each VPS protein had little effect on particle release. M protein particle release was inhibited by dn-CHMP3 to about 90%. (FIG. 68, Panels A and B). Vps4A-E228Q inhibited M protein VLP release by about 90% (FIG. 68, Panels C and D), and AIP-1-RFP inhibited particle release by 90% (FIG. 68, Panels E and F). The dominant negative forms of CHMP3, Vps4A, and AIP1, but not the wild type forms, inhibited the release of VLPs containing all four viral proteins. FIG. 69.

These combined results show that the inhibition of VLP release was not due to over expression of the VPS protein, but rather due to specific effect of the dn mutant proteins. These results support the conclusion that an intact VPS pathway facilitates M protein particle release.

Example 20

YANL Sequence Mutations Inhibit VLP Release

This example presents data showing that the L domain of an NDV M protein plays a role in particle budding. For example, the sequence of a NDV M protein has two possible L domain sequences, PKSP and YANL, which are similar to the classical L domains PTAP and YPXL, respectively (Freed, E. O., "Mechanisms of enveloped virus release" *Virus Res* 106:85-86 (2004)). The data below show that by inducing mutations in these L domain sequences, VLP release maybe inhibited.

The proline residues in the PKSP sequence were substituted with alanine (M-$A_{216}A_{219}$); and the tyrosine and leucine in the YANL sequence were substituted with alanine (M-$A_{232}A_{235}$) (FIG. 70, Panel A). These mutant M proteins were expressed either individually (FIG. 70, Panel B, extracts) or in combination with NP, F-K115Q and HN proteins (FIG. 70, Panel D, extracts). Particles were released from cells expressing the M-$A_{216}A_{219}$ mutant at levels comparable to cells expressing wild type M protein. FIG. 5, Panels B-E.

In contrast, there was a significant reduction of particles released from cells expressing the M-$A_{232}A_{235}$ mutant (FIG. 70, Panel B). Similarly, co-expression M-$A_{232}A_{235}$ mutant protein with NP, F-K115Q and HN proteins resulted in 80% reduction in particles released (FIG. 70, Panel D, compare lanes 6 and 8 and Panel E). Amounts of VLPs released from cells co-expressing the M-$A_{216}A_{219}$ mutant protein with NP, F-K115Q and HN proteins were comparable to wild type levels (FIG. 70, Panel D, lanes 6 and 7).

To determine if the inhibition of particle release by mutation of the YANL sequence was due to elimination of L domain activity or defects in conformation of the M protein, the YANL sequence was substituted separately with two known classical L domain sequences, YPDL and PTAP (Morita et al., "Retrovirus budding" *Annu Rev Cell Dev Biol* 20:395-425 (2004); Strack et al., "AIP1/ALIX is a binding partner for HIV-1 p6 and EIAV p9 functioning in virus budding" *Cell* 114:689-699 (2003)).

Both the YPDL and PTAP sequences supported release of the NDV M protein particles. FIG. 705, Panels B & C. The amounts of particles released from NDV M protein containing the substituted YPDL and PTAP motif were comparable to wild type levels. These results strongly indicate that the YANL sequence at position 232 to 235 in the NDV M protein functions as an L domain.

Retrovirus particles, which have a gag protein with an YPXL L domain, contain AIP1 (Strack et al., "AIP1/ALIX is a binding partner for HIV-1 p6 and EIAV p9 functioning in virus budding" *Cell* 114:689-699 (2003)) and may represent a polypeptide with an approximate size of 100 kD in the SDS-PAGE gels containing NDV VLP proteins or virion proteins. AIP1 was incorporated into NDV particles and VLPs, thereby co-expressing M protein with an HA-tagged AIP1 at either the N-terminal (HA-AIP 1) or the C-terminal (AIP1-HA), or with vector alone. M protein particles were released from both cells expressing M protein with vector and cells expressing M protein and either HA-tagged AIP1. FIG. 71, Panel A. The expression of HA-AIP1 and AIP1-HA were at comparable levels (FIG. 71, panel A, IB extract gel, lanes 2 and 3). However, only AIP1-HA incorporated into VLPs (FIG. 71, panel A, IB VLP gel lane 3). AIP1-HA can also be precipitated from purified disrupted VLPs. FIG. 71, Panel B, right.

These results demonstrated that AIP1 is incorporated into VLPs and suggest that AIP1 may be interacting directly or indirectly with the M protein in particles.

Example 21

Co-Immunoprecipitation

Purified VLPs were incubated in ice cold TNE buffer (25 mM Tris HCl, pH 7.4, 150 mM NaCl, 5 mM EDTA) containing 1% Triton X-100, 2.5 mg/ml N-ethylmaleimide for 15 minutes. Excess primary antibody was added and VLPs were incubated at 4° C. overnight. Pansorbin cells, blocked overnight in TNE buffer containing 1% Triton X-100 and 5 mg bovine serum albumin (BSA) and then prewashed in TNE containing 1% Triton X-100 and 1 mg/ml BSA, were added in excess as determined in preliminary experiments, and incubation was continued at 4° C. with constant mixing for at least 2 h. Immune complexes were collected by centrifugation (10,000 rpm for 30 seconds in a microcentrifuge) and washed three times in ice-cold TNE containing 0.5% Triton X-100. The pelleted complexes were resuspended in gel sample buffer.

Example 22

Protease Protection Assay

Protease digestion of M protein from avian cell extracts and VLPs was accomplished by adding 0.25, 0.5, 1, 5, 10, and 20 µg of proteinase K per ml of sample and incubating for 30 min on ice. In parallel, VLPs were also made 0.5% with respect to Triton X-100 prior to incubation with proteinase K. After digestion, phenylmethylsulfonyl fluoride (PMSF) (0.1 M) was added. For subsequent immunoprecipitation, the reaction mixtures were made 1% with respect to Triton X-100 and 0.5% with respect to sodium deoxycholate.

Example 23

Immunofluorescence Microscopy

Avian cells, grown in 35 mm dish containing glass coverslips, were transfected with different combinations of NDV cDNAs as described above. After 40 hours, nuclei were stained with 5 µg/ml 4',6-Diamidino-2-phenylindole (DAPI) for 30 min at 37° C. Cells were washed twice with ice-cold immunofluoresecence (IF) buffer (PBS containing 1% bovine serum albumin, 0.02% sodium azide, and 5 mM $CaCl_2$), fixed with 2% paraformaldehyde, blocked with IF buffer for 2 hours, and incubated for 1 hour at 4° C. in IF buffer containing polyclonal antibodies against HN and F proteins.

Cells were washed twice with ice-cold IF buffer, permeabilized with 0.05% Triton X-100, blocked with IF buffer for at least 2 hours and incubated for 1 hour at 4° C. in IF buffer containing purified ascites fluids containing anti-M protein monoclonal antibody (52-E5). Cells were then washed twice with ice-cold buffer followed by incubation for 1 hour at 4° C. in IF buffer containing fluorescein conjugated goat anti-rabbit IgG (Alexa® 488; Molecular Probes) and rhodamine conjugated goat anti-mouse IgG (Alexa® 568; Molecular Probes) secondary antibodies. Cells were washed with ice-cold IF buffer, mounted onto slides using a mounting medium (Vectashield®, Vector Labs, Inc) for immunofluorescence microscopy. Fluorescence images were acquired using a Nikon fluorescence microscope and Openlab® software and processed using Adobe Photoshop®.

Example 24

Membrane Associated M Protein

This example provides data confirming sucrose gradient data suggesting that M protein may be associated with membranes by incubation with a protease.

VLPs and cell extracts were either left untreated (FIG. 62, lane 1) or treated with different concentrations of Proteinase K (lanes 2 to 7). As expected, the M protein in cell extracts was sensitive to low concentrations of protease (FIG. 62 upper panel). The lower band below the M protein is a protease digestion product indicating that M protein has a protease resistant core. However, M proteins in VLPs were largely protected from protease digestion (FIG. 62, middle panel). In contrast, disruption of the particle membrane with detergent resulted in digestion of the M protein (FIG. 62, lower panel).

Taken together, these results demonstrated that the M protein VLPs are membrane-bound particles.

Example 25

M Protein Mediated VLP Release

This example extends the data relevant to M protein sufficiency for VLP release by studying the release of VLPs in the absence of an M protein gene.

Cells were transfected with all possible combinations of NP, F, and HN cDNAs in the absence of the M gene. Cells expressing any combination of proteins without M protein did not release VLPs. FIG. 63. Furthermore, in the absence of M protein, NP, F and HN proteins (expressed in pair-wise combinations) were retained in cell extracts after the 8 hour chase (FIG. 3; Panel A: lanes 2, 4 and 5, and Panel C).

These results strongly suggest that VLP release is mediated by the M protein.

Example 26

M Protein/Glycoprotein Co-Localization

This example explores further the role played by each protein in VLP assembly. Specifically, the plasma membrane localization of M, F and HN proteins was determined by immunofluorescence.

Transfected cells were incubated with anti-F protein or anti-HN protein antibodies prior to cell permeabilization to limit binding of antibodies to cell surface F or HN proteins. Cells were then permeabilized using 0.05% Triton X-100 and then incubated with M protein specific antibody.

Figure 64:
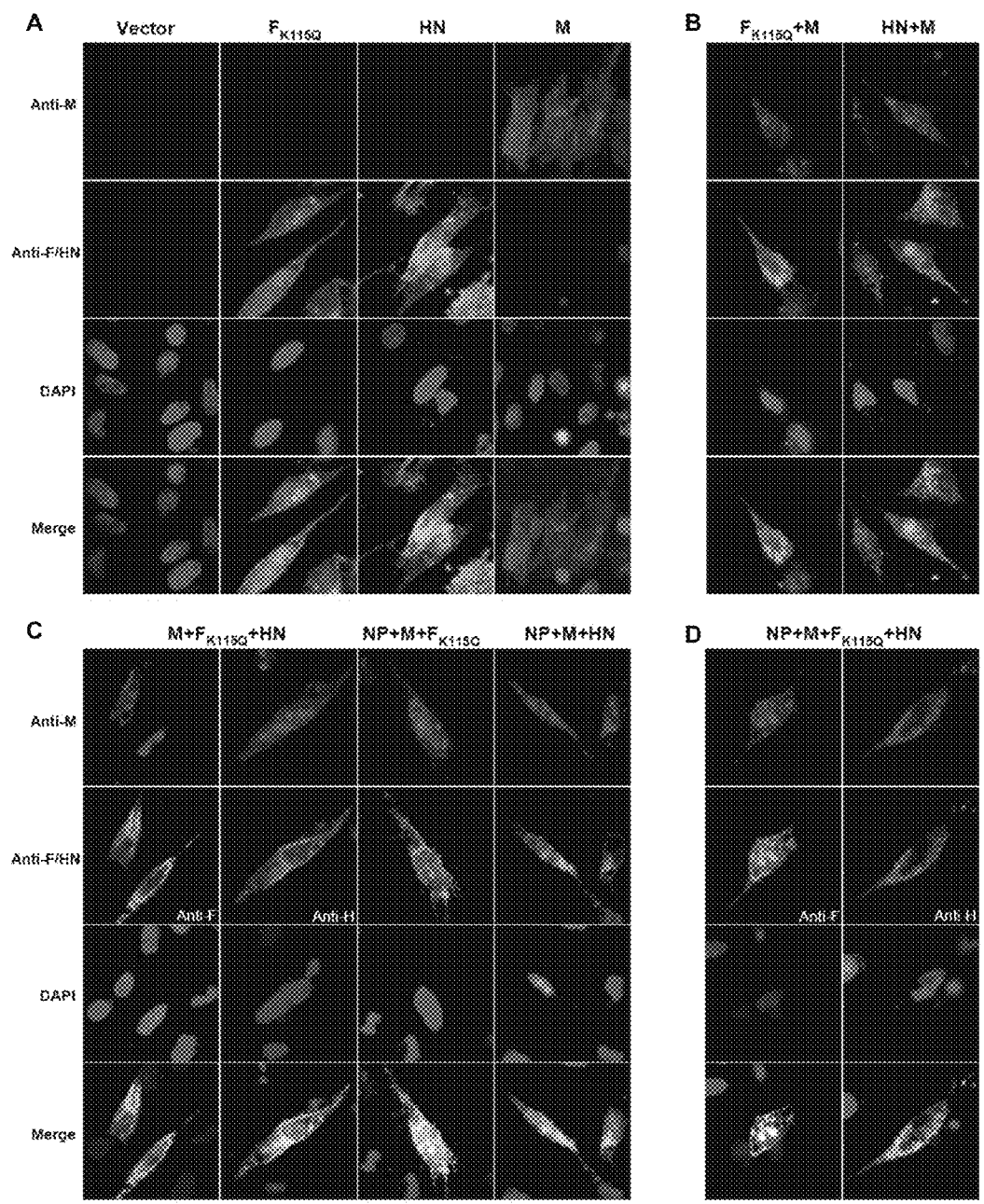
Figure 65A:
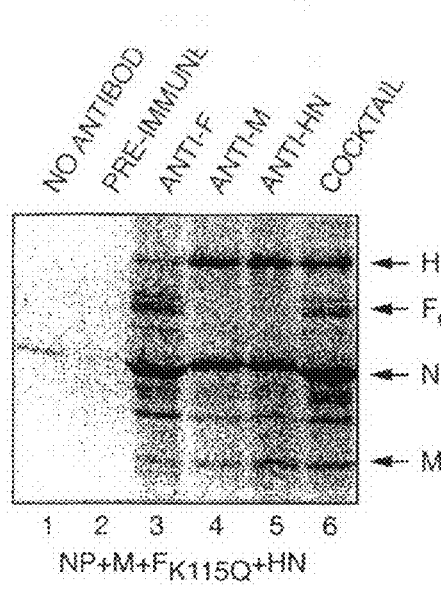
Figure 65B:
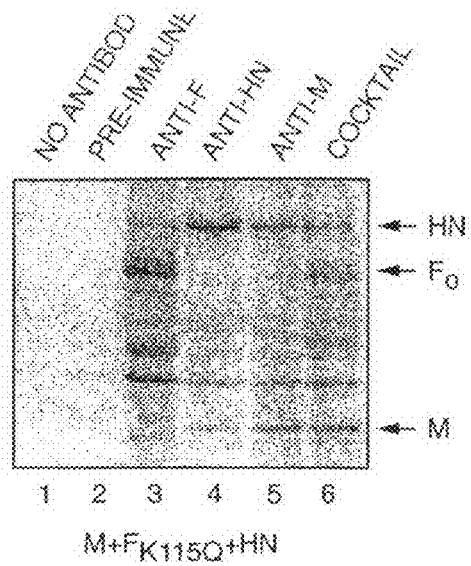
Figure 65C:
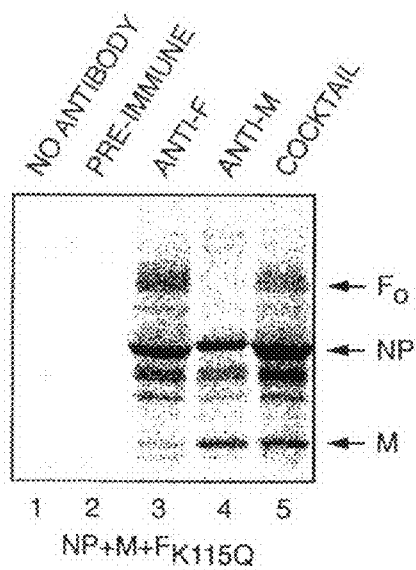
Figure 65D:
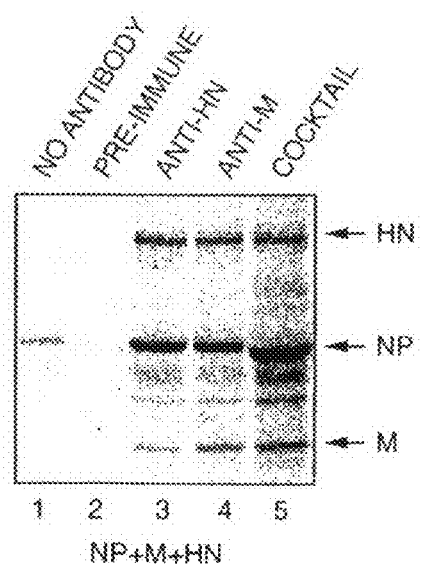

Vector-transfected control cells and as well as cells expressing individually M, F-K115Q or HN proteins, demonstrated that the F-K115Q and HN proteins were diffusely distributed on the surface of the cells (FIG. 64, Panel A). M protein exhibited diffuse cytoplasmic staining as well as punctate structures of various sizes (FIG. 64, Panel A; anti-M image and merged image). Co-expression of either F or HN proteins with M protein, however, had little effect on the distribution of M protein, F protein, or HN protein. Further, little to no co-localization of F or HN glycoproteins with M protein was observed. FIG. 64, Panel B. These findings correlate with the very low incorporation of F or HN proteins into M protein containing VLPs after pair-wise co-expression.

Co-expression of M protein with at least two other proteins slightly changed the distribution of M protein. For example, M protein co-expression with F and HN proteins increased the co-localization of M protein with either F or HN proteins. FIG. 64, Panel C. This result is consistent with an increased incorporation of HN, F, or NP proteins when two proteins are co-expressed with M protein.

When all four proteins were co-expressed, the distribution of M protein was changed to more punctuate structures distributed mostly along the edges of the cells. Further, most of the F or HN protein signal co-localized with the M protein. FIG. 64, Panel D. Although it is not necessary to understand the mechanism of an invention, it is believed that this result is consistent with a more ordered assembly of VLPs when all four proteins are co-expressed.

Altogether, these results suggest that co-localization of viral proteins is detected with expression of three proteins and is most dramatic when NP, M, F and HN proteins are co-expressed. These results also suggest that there are specific protein-protein interactions involved in assembling particles.

Example 27

VLP Viral Protein Interactions

This example provides identification of several specific protein interactions involved in VLP assembly using co-immunoprecipitation techniques.

Radioactively labeled VLPs formed with different combinations of proteins were solubilized in 1% Triton X-100 and the proteins present were precipitated, separately, with cocktails of monospecific antibodies for M, HN or F proteins. Proteins were also precipitated with a mix of antibodies with specificities for all proteins in order to precipitate total VLP proteins (lane 6).

First, each antibody cocktail precipitated all proteins from VLPs formed with M, HN, F and NP, although the efficiency of precipitation for each protein varied with the antibody specificity (FIG. 65, Panel A). Although it is not necessary to understand the mechanism of an invention, it is believed that these results are consistent with a network of interactions between all four proteins such that precipitation of one resulted in the precipitation of the other three proteins.

The results also suggested that proteins indirectly linked to the precipitated protein were less efficiently precipitated than a protein directly linked to a precipitated protein. For example, anti-F protein antibody precipitated NP very efficiently but M protein very inefficiently (lane 3). This observation suggests that there may be a direct link between F protein and NP, but not F protein and M protein.

The protein interactions in VLPs were more clearly defined by precipitation of proteins from VLPs formed with all combinations of three proteins. In VLPs released from cells expressing M, F-K115Q and HN proteins, anti-F protein precipitated only F protein and traces of HN protein (FIG. 65, Panel B, lane 3). This result indicates that the F protein does not directly complex with the M protein.

Anti-HN protein antibody co-precipitated M protein and HN protein (FIG. 65, panel B, lane 4). Likewise, anti-M protein antibody co-precipitated HN protein and M protein (FIG. 65, panel B, lane 5). These results strongly suggest that the M protein interacts with HN protein but not with the F protein.

VLPs were also released containing NP, M and F-K115Q proteins. Anti-F protein antibody co-precipitated NP and F protein, but not M protein. (FIG. 65, panel C, lane 3). Anti-M protein antibody co-precipitated NP and M protein, but not F protein (FIG. 65, panel C, lane 4). These observations indicate that M protein directly interacts with NP and that the F protein interacts with NP and confirm that F and M protein do not interact.

Although it is not necessary to understand the mechanism of an invention, it is believed that anti-M protein antibody does not indirectly precipitate detectible amounts of F protein because an inefficient precipitation of NP protein may decrease the amounts of F protein precipitated to very low levels. Alternatively, NP—NP interactions required to precipitate F protein with anti-M protein antibody may be disrupted by VLP lysis. For example, when VLPs containing NP, M and HN were used, complexes formed with anti-HN protein antibody contained NP and M proteins as well as FIN protein (FIG. 65, panel D, lane 3). In addition, anti-M protein antibody precipitated NP and FIN proteins (FIG. 65, panel D, lane 4). These observations are consistent with the conclusion that the M protein interacts with both NP and HN proteins. It is further contemplated that, in one embodiment, HN protein and NP protein may interact.

Overall, results of co-immunoprecipitation of proteins in VLPs as well as results of cellular co-localization studies provide a rational basis for the incorporation of viral proteins into VLPs and suggest that specific protein interactions are involved in the assembly of an NDV virus-like particle.

Example 28

Comparison of NDV and Influenza VLP Release

In order to determine if an NDV platform for presentation of influenza virus antigens in a vaccine had an advantage over use of influenza VLPs, the inventor compared the release of VLPs from comparable numbers of avian ELL-0 cells expressing the influenza M1, HA, and NA proteins with cells expressing the NDV M, NP, F, and HN proteins. FIG. 163 shows the total proteins associated with particles (VLPs) released from each culture. Quantification of release of influenza VLPs and ND VLPs showed that, based on release of M1 and M proteins and the release of HA and HN proteins, the ND VLP release was 30-100 fold higher respectively, over a 24 hour period than that of influenza VLPs These results demonstrate that ND VLPs were much more efficiently released than influenza virus VLPs. The inventor therefore proceeded to explore the incorporation of influenza HA and NA proteins into ND VLPs.

Example 29

Construction of Chimera Type 1 Protein Genes

Because the inventors considered it likely that specific incorporation of a glycoprotein into ND VLPs would require the CT and TM domains of the NDV glycoproteins for interactions with NDV M or NP proteins, a hybrid gene was constructed with the ectodomain of the influenza HA and the TM and CT domains of the NDV F protein. The constructions are diagramed in FIG. 164. Three constructions were made which varied the junction sequences. Chimera #1 joined the two domains without additional amino acids. Chimeras #2 and #3 included two to three additional amino acids to provide some flexibility between the two domains.

Example 30

Expression of Chimera HA/F Proteins

The inventor next determined if the chimera proteins were expressed, folded, and delivered to cell surfaces. FIG. 165 shows that all three chimera proteins were expressed in ELL-0 avian cells and precipitated with antibody specific for influenza HA. All were detected at cell surfaces at levels comparable or better than the wild type HA protein. The chimera proteins were also detected with antibody specific for the cytoplasmic domain (CT) (anti-Ftail) of the NDV F protein showing that they were chimera proteins.

Example 31

Incorporation of an HA/F Chimera Protein into ND VLPs

HA/F #1 was used to determine if chimera type 1 proteins could be incorporated into ND VLPs. HA/F#1 cDNA was co-transfected with NDV M and NP protein cDNAs as well as various combinations of NDV glycoprotein cDNAs into ELL-0 cells. In addition, to compare the efficiency of the wild type HA protein incorporation into ND VLPs with the chimera protein, duplicate transfections were performed substituting the wild type HA cDNA for the HA/F chimera protein cDNA. Particles released from each of these transfections were purified by centrifugation through a 20% sucrose pad and the proteins present in each particle preparation were resolved by polyacrylamide gel electrophoresis (FIG. 166).

The results show that, most significantly, the HA/F chimera can be incorporated into ND VLPs. In addition, the data show that wild type HA was minimally incorporated into ND VLPS. Further, the data show that the HA/F chimera was most efficiently incorporated into ND VLPs in the presence of only NDV M and NP. Inclusion of NDV wild type fusion (Fwt) protein allows incorporation of the HA/F while the uncleaved F (F-K115G) inhibits chimera incorporation. Inclusion of both HN and F protein appears to inhibit incorporation of the chimera protein.

To determine the relative roles of HN, F, and NP proteins in incorporation of HA/F chimera, the chimera cDNA was transfected with glycoproteins in the absence of NP and with each NDV glycoprotein individually. All combinations contained NDV M protein cDNA. The results are shown in FIG. 167.

These results indicate that efficient chimera protein incorporation into ND VLPs occurs in the presence of NP. In the presence of NP, HN protein, in the absence of F protein, allows incorporation of the chimera protein and F protein, in the absence of HN protein allows incorporation of the chimera.

The data show that a chimera protein which contains the ectodomain of the HA glycoprotein fused to the TM and CT domain of the NDV F protein can be expressed, transported to cell surfaces. The data also show that the HA/F chimera protein was incorporated into ND VLPs. Further, the data demonstrate that incorporation of the HA/F protein occurs upon M and NP protein expression. Moreover, the data show that incorporation of the chimera protein also occurs when NDV F or HN protein was co-expressed with the chimera protein.

It was the inventor's opinion that the HA/F chimeras #2 and #3 will be more efficiently incorporated into ND VLPs as both of these chimera proteins were expressed on cell surfaces at higher levels than HA/F #1.

Example 32

Construction of Chimera Type 2 Glycoprotein Genes and Expression of the HN/NA Chimera Protein To test the expression and VLP incorporation of a type 2 glycoprotein chimera into ND VLPs, sequences encoding the ectodomain of the influenza NA protein were fused to sequences encoding the NDV HN protein CT and TM domains in order to construct a chimera protein gene between these two type 2 glycoproteins. FIG. 168 shows a diagram of the construction. FIG. 169 shows that the chimera HN/NA protein was expressed in avian cells (lane 3).

Example 33

Incorporation of HN/NA Chimera Protein into ND VLPs

To test the incorporation of the HN/NA chimera protein into ND VLPs, ELL-0 cells were transfected with cDNAs encoding the NDV M and NP proteins along with the cDNA encoding the chimera protein. The inventor also transfected cells in parallel with cDNAs encoding the wild type influenza HA, NA, and M1 proteins in order to compare release of the chimera protein in ND VLPs with release of the wild type NA in influenza VLPs. FIG. 170 shows the proteins in particles released from each of these cell populations. Clearly the HN/NA chimera was very efficiently incorporated into ND VLPs containing the M and NP protein. The levels of release were significantly increased over levels of wild type NA protein released in influenza VLPs. Interestingly, a small amount of the HN/NA chimera protein was released as a particle when expressed alone.

To determine the role of NP, F, and HN protein on the incorporation of the HN/NA chimera protein into ND VLPs, the chimera protein was expressed with M protein and different combinations of NP, HN, and F protein. The results are shown in FIG. 171.

The results show that NP expression is important for HN/NA protein incorporation. Addition of F protein increases incorporation and addition of both NDV glycoproteins with NP significantly enhances incorporation of the chimera protein.

The data show that an HN/NA chimera can be expressed. The data also show that an HN/NA chimera can be incorporated into ND VLPs very efficiently. In addition, the data show that incorporation of the HN/NA chimera occurs in the presence of M and NP expression, and incorporation was enhanced by the co-expression of F protein, or a combination of HN and F proteins.

Example 34

ND VLPs Stimulate Immune Responses in Mice

Use of ND VLPs as a vaccine platform requires that these particles will stimulate an immune response in animals. To determine if these particles are effective immunogens, the inventor first developed conditions to purify the VLPs and to generate significant quantities for use as an immunogen.
A. Purity of VLPs Purification of VLPs was based on standard protocols used to purify intact virus grown in eggs. FIG. 172 shows a silver stain of the purified VLPs as well as purified NDV, strain B1, grown in eggs. Clearly the VLPs were as pure as the virus stock. Significantly, the amounts of HN and F proteins relative to NP were higher in the VLPs. The cDNAs, used to generate VLPs, were derived from NDV, strain AV. This strain of NDV has increased amounts of glycoproteins in egg grown virus preparations compared to the egg grown avirulent B1 strain.
B. Generation of Microgram Quantities of VLPs Because the release of VLPs was so efficient from avian cells, this experiment was conducted to determine if microgram quantities of these particles could be generated from transiently transfected avian cells. Indeed, only a minor scale up of the numbers of cells used yielded significant amounts of these particles. VLPs and egg grown B1 virus were purified using protocols used to purify virus from allantoic fluid of infected eggs (McGinnes et al. (2006) Newcastle Disease Virus: Propagation, quantification, and storage," Vol 1, John Wiley and Sons, Inc.) Proteins, separated in polyacrylamide gels, were visualized by silver staining (see FIG. 172). Protein concentrations were measured by using albumin as a standard. Table 14 shows a comparison of yields of VLPs with an egg grown stock of virus. These VLPs were used to immunize mice.

TABLE 14

Yields of VLPs from tissue culture cells

| Particle | Protein | Conc (ng/ml) | Total volume | Total protein (µg) |
|---|---|---|---|---|
| Strain B1 virus (from 3.3 dozen eggs) | H | 23.05 | 1 ml | 23.05 |
| | F | 11.09 | | 11.09 |
| | NP | 100.32 | | 100.09 |
| | M | 75.08 | | 75.08 |
| | Total | | | 209.54 |
| VLP (from 1.0 × 10⁸ cells) | HN | 109.70 | 0.5 ml | 54.85 |
| | F | 85.42 | | 42.71 |
| | NP | 98.24 | | 49.71 |
| | M | 63.50 | | 31.75 |
| | Total | | | 178.43 |

Example 35

Immunization

Groups of five BALB/c mice were injected with different concentrations of VLPs or virus. Importantly, the inventor did not use any adjuvant, the absence of which significantly decreases toxic effects of vaccination in animals. One group of mice received 10 micrograms of total VLP protein, another group received 20 micrograms, and a third group received 40 micrograms. In parallel, groups of mice were injected with UV inactivated virions (10, 20, or 40 micrograms of total viral protein). Sham vaccinated mice (using phosphate buffered saline) were included in the protocol. The mice were injected intraperitoneally (IP). A second injection of 10 micrograms of either VLPs or virus was given to each mouse (IP) in the VLP or virus groups, respectively, on day 27. Sera were collected from the tail veins on day 10, day 20, day 37, and day 49.

On day 50, spleens were collected, and spleen cells were co-cultured for 6 days with NDV infected P815 cells. These spleen cells were then assayed for CTL activity as well as intracellular cytokine staining. UV inactivated virus was used as an immunogen since injection of live NDV into animals is not permitted by the USDA.
A. ELISA Titers of Soluble Antibody The anti-NDV antibody in each mouse serum was titered by serial dilution in an ELISA assay using as capture antigen purified, egg grown NDV that had been disrupted with Triton X-100. FIG. 173 shows a scatter plot of the titers of antibodies in the serum of each animal immunized with VLPs, while the results after virus immunization are shown in FIG. 174.

These results show that VLPs can stimulate a robust soluble immune response in mice, a response that was at least as good as that stimulated by virus. Furthermore, as little as 10 micrograms of total VLP protein was sufficient to result in significant soluble immune responses.

B. CTL Activities of Spleen Cells from Immunized Mice

The cytotoxic T lymphocyte (CTL) activities of spleen cells, harvested at 50 days post immunization and stimulated in vitro with NDV infected cells, were measured in a standard chromium release assay and the percents of cell lysis of target cells (NDV infected P815 cells) at different effector to target ratios are shown in FIG. 175.

The results show that VLPs do stimulate CTL activity and that, under these conditions, the levels were at least as high as those detected after immunization with virus particles.

C. Intracellular Cytokine Staining of Spleen Cells from Immunized Mice

As an additional measure of T cell activation after immunization with either VLPs or virus, spleen cells harvested and stimulated, as described above, were characterized for intracellular expression of gamma interferon. The percent of CD8+ cells that were positive for interferon gamma is shown in FIG. 176, left panel, while the percent of CD4+ cells that were positive for this cytokine expression is shown in FIG. 176, right panel.

The results show that VLPs can stimulate CD8 and CD4 T cells as well as inactivated virus. The above data also demonstrate that VLPs can stimulate both soluble and cellular immune responses to the NDV proteins. The data also show that the VLPs were at least as good an immunogen as virus particles. The data also show that very small amounts of total VLP protein were effective as immunogens. These results demonstrate that foreign proteins incorporated into NDV VLPs stimulate robust immune responses.

Example 37

Incorporation of Cytotoxic T Lymphocyte (CTL) Epitope into Newcastle Disease (ND) VLPs Using the above described methods, the CTL epitope sequence YPYDVPDYA (SEQ ID NO: 227) was expressed in ELL-0 cells as a fusion protein that was fused to the carboxyl terminus of NDV HN protein, to the amino terminus of NDV NP protein, or to the carboxyl terminus of the NDV NP protein. Each of the three fusion proteins resulted in the incorporation of the CTL epitope into VLPs.

All publications and patents mentioned in the above specification are herein incorporated by reference. Various modifications and variations of the described compositions and methods of the invention will be apparent to those skilled in the art without departing from the scope and spirit of the invention. Although the invention has been described in connection with specific preferred embodiment, it should be understood that the invention as claimed should not be unduly limited to such specific embodiments. Indeed, various modifications of the described modes for carrying out the invention which are obvious to those skilled in the art and in fields related thereto are intended to be within the scope of the following claims.

SEQUENCE LISTING (384 sequences)

SEQ ID NO: 1 - protein, 4 aa, Epstein Barr virus
FPIV

SEQ ID NO: 2 - protein, 4 aa, Artificial Sequence
  Synthetic
  misc_feature (2)..(3): Xaa can be any naturally occurring amino acid
PXXP

SEQ ID NO: 3 - protein, 4 aa, Artificial Sequence
  Synthetic
  misc_feature (2)..(3): Xaa can be any naturally occurring amino acid
YXXL

SEQ ID NO: 4 - protein, 4 aa, Artificial Sequence
  Synthetic
PTAP

SEQ ID NO: 5 - protein, 4 aa, Artificial Sequence
  Synthetic
  misc_feature (3)..(3): Xaa can be any naturally occurring amino acid
PPXY

SEQ ID NO: 6 - protein, 489 aa, Newcastle disease virus
MSSVFDEYEQLLAAQTRPNGTHGGGEKGSTLKVEVPVFTLNSDDPEDRWNFAVFCLRIAVSEDANKPLRQGALISLLCSHSQVMRNHVALAGKQNEATLAVLEIDSFADSVPQFNNRSGVSEERAQRFMVIAGSLPRACSNGTPFVTAGVEDDAPEDITDTLERILSIQAQVWVTVAKAMTAYETADESETRRINKYMQQGRVQKKYILHPVCRSAIQLTIRHSLAVRIFLVSELKRGRNTAGGSSTYYNLVGDVDSYIRNTGLTAFFLTLKYGINTKTSALALSSLTGDIQKMKQLMRLYRMKGENAPYMTLLGDSDQMSFAPAEYAQLYSFAMGMASVLDKGTGKYQFARDFMSTSFWRLGVEYAQAQGSSINEDMAAELKLNPAARRGLAAAAQRVSEEIGNMDIPTQQAGVLTGLSDKGPRAPQGGPSRSQGQPDAGDGETQFLDLMRAVANSMREAPNSAQSTIHPEPLPTHGPSQDNDTDWGY

SEQ ID NO: 7 - DNA, 1470 bp, Newcastle disease virus
atgtcgtccgtatttgacgaatacgagcagctcctcgctgctcagacccgccctaacggaactcatggagggggagagaaagggagcactttaaaagttgaggtcccagtatttacccttaacagtgatgatccagaggatagatggaattttgcggtattctgtcttcggattgctgttagcgaggatgccaacaaaccactcaggcaaggtgctcttatatccctcttatgctcccattctcaggtgatgagaaaccacgttgcccttgcagggaaacagaatgaggctacactggctgttcttgagatcgatagttttgccgacagtgtgccccagttcaacaataggagtggagtgtctgaggaaagagcacagagattcatggtaatagcaggatctctccctcgggcatgcagcaacggtactccgttcgtcacagctggggttgaagatgatgcaccagaagatatcactgacactctggaaagaatcctatctatccaggctcaggtatgggtcacagtagcaaaggccatgactgcatatgagacagcagatgagtcggaaacaagaagaataaataagtatatgcagcaaggtagagtccagaagaaatacatccttcaccctgtatgcaggagtgcaattcaactcacaatcagacattctctggcagtccgtattttcctagttagtgagctcaagaggggccgcaatacagcaggtgggagctccacatattacaacttggtcggggatgtagactcatacatcagaaacaccgggcttactgcatttttcctaacactcaaatatggaatcaataccaagacgtcagccctcgcactcagcagcctcacaggtgatatccaaaaaatgaaacagctcatgcgtttatatcggatgaaaggtgaaaatgcaccatacatgacattgttaggtgacagtgaccagatgagctttgcaccagctgagtatgcacaactttattcttttgccatgggcatggcatcagtcttagataagggaactggcaaataccaattcgccagagacttcatgagcacatcattctggagactcggggtggagtatgctcaggctcagggaagtagcatcaatgaagatatggctgctgaattgaaacttaacccagcagcaaggaggggcctggcagctgctgcccaacgagtatctgaggaaattggcaacatggatattcctactcaacaggccggggtccttactgggctcagcgacaaaggtccccgagctccacagggtggaccgagcaggtcgcaagggcaaccggacgccggggatggggagacccaattcctggatctgatgagagcagtggcaaacagcatgcgagaagcgccaaattctgcacagagcaccattcacccggagcctctcccaactcatgggccatctcaagacaacgacaccgactgggggtactga

SEQ ID NO: 8 - protein, 571 aa, Newcastle disease virus
MDRVVSRVVLENEEREAKNTWRLVFRIAVLSLVVMTLAISVATLVYSMEASTPGDLAGISTVISKAEDKVISLLSSNQDVVDRVYKQVALESPLALLNTESVIMNAITSLSYQINGAANNSGCGAPVHDPDYVGGVGKELIVDDTSDVTSFYPSAYQEHLNFIPAPTTGSGCTRIPSFDMSATHYCYTHNVILSGCRDHSHSHQYLALGVLRTSATGRVFFSTLRSINLDDTQNRKSCSVSATPLGCDMLCSKVTEIEEEDYKSATPTSMVHGRLGFDGQYHEKDLDVTALFKDWVANYPGVGGGSLIGDRVWFPVYGGLKPNSPSDIAQEGRYVIYKRYNNTCPDEQDYQVRMAKSSYKPGRFGGKRVQQAILSIKVSVSLGEDPVLTVPPNTVTLMGAEGRVLTVGTSHFLYQRGSSYFSPALLYPMTIHNKTATLHSPYTFNAFTRPGSVPCQASARCPNSCITGVYTDPYPVVFHKNHTLRGVFGTMLDNEQARFNPVSAVFDYTSRSRITRVSSSSTKAAYTTSTCFKVVKTNKIYCLSIAEISNTLFGEFRIVPLLVEILKDDRV

SEQ ID NO: 9 - DNA, 2120 bp, Newcastle disease virus
acgggtagaacggtgggagaggccaccccttagtggggaaccaagcttcttaacgtccgttctaccgcattaccaatagcataccttagtcatggatcgtgtagttagtagggttgtactagagaatgaggaaagagaagcaaagaacacatggcgcctggtttttcggatcgcagtcttatctctagtagtaatgactttagctatctctgttgccaccctagtatacagcatggaggctagcacaccgggcgatctggcgggcatatcgacggtgatctctaaggcagaggataaggtgatatctctactcagttcaaatcaagatgtggtagatagggtatataaacaggtggcccttgagtccccactggcattgctgaatactgagtctgtaattatgaatgcaataacttctctctcctatcaaattaacggagccgcaaataatagtgggtgtggggcacctgttcatgacccagattacgttgggggagtaggcaaagagctcatagtagatgacacaagtgatgtcacatcattctacccttcagcataccaagaacacctgaattttatcccggcgcctactacaggatcaggctgcactcggataccctcgttcgacatgagcgctacccattattgttatactcacaatgtaatattatctggttgcagagatcactcacactcacatcagtatttagcactaggtgtacttcggacatctgcaacagggagggtattcttttctactctgcgctccatcaatttggatgacacccaaaatcggaagtcttgcagtgtgagtgcgactcctttaggttgtgatatgctgtgctctaaagtcacagarattgaagaggaggattataagtcagctactcccacatcaatggtgcatggaaggttaggrtttgacggtcagtatcatgagaaggacttagacgtcacagccttatttaaggattgggttgcaaattatccaggagtgggaggagggtctcttattggcgaccgtgtatggttcccagtttatggagggcttaaacccaattcgcctagtgacattgcacaagaggggagatatgtaatatataagcgctataataacacatgccccgatgaacaggattaccaagttcggatggctaagtcttcatataagcctggacggtttggtggaaagcgcgtacagcaagccatcttatctatcaaagtatcagtatctttgggcgaggacccggtgctaaccgtaccccctaatacagttacactcatgggggccgaaggcagggtcctcacagtagggacatctcacttcttgtaccaacgagggtcttcatacttctctcccgccttactataccctatgacaatacacaacaaaacagctactcttcatagtccctatacattcaatgctttcactcggccaggcagtgtcccctgccaggcatcagcaaggtgccccaactcatgcatcactggagtctatactgatccatatcctgtggtctttcataagaatcacaccctgcgaggggtattcgggacgatgcttgataatgaacaagcaaggttcaaccctgtatctgcagtatttgattacacatctcgcagtcgcataacccgggtaagttcgagcagcaccaaggcagcatacacgacatcgacatgttttaaagttgtcaagaccaataaaatttattgtcttagcattgcagaaatatccaataccctatttggggaattcaggattgtccctctactggttgagatcctcaaggatgatagggtttaagaggctaagttcagccggccgggtcaaccacgaggaagacgggaagatggcgttgtgtcacctaccctctgcaatgccaaggatcaagcggaataataatactagcccgaatctcatgctatcagacagccttaatcggataatgctgacacgatcagcttgaatcctgtcaatagtcactctgtttagaaaaaatatgagaggtggtgggatataagagaaaacaacttacagaagatagcacgggtaggacatggcgggctccggtcccgaaagggcagagcaccagattatcctaccagagtcacacctg

SEQ ID NO: 10 - protein, 256 aa, Newcastle disease virus
MGSKPSTRIPVPMMLITQIVLILSCICLTSSLDGRPLAAAGIVVTGDKAVNIYTSSQTGSIIVKLLPNMPKDKEACAKAPLEAYNRTLTTLLTPLGDSIRRIQGSVSTSRGRRQKRFIGAIIGSVALGVATSAQITAAAALIQANQNAANILRLKESIAATNEAVHEVTDGLSQLAVAVGKMQQFVNDQFNNTARELDCIKITQQVGIELNLYLTELTTVFGPQITSPALTQLTIQALYNLAGGNMDYLLTKLGVG

SEQ ID NO: 11 - DNA, 993 bp, Newcastle disease virus
tgaggttacttctactaggttagagaagaggcacaccattgctaaatacaatcctttcaagaagtaagttgcgtccctgagactgcgatccacccactttcctggatcatcgcaacgcaaaataatgatctgtctcgattgcttgcagttggttcacctgtctatctagttagaaaaaacacgggtagaagagtctggatcccagctggcacattcaaggtgcagtatgggctctaaaccttctaccaggatcccagtacctatgatgctgatcacccaaattgtgttgatactgagctgtatctgtctgacaagctcccttgacggcaggcctcttgcagctgcggggattgtggtaacaggagataaagcagtcaatatatacacctcatctcagacggggtcaatcatagtcaagttgctcccaaatatgcccaaggataaagaggcgtgtgcaaaagccccgttagaagcatacaacagaacactgaccactttactcaccccccttggtgattccatccgcaggatacaagggtctgtgtccacatcaagaggaaggagacagaaacgctttataggtgccattatcggcagtgtagctcttggggtcgcaacatcggcacagataacagcagctgcggccctaatacaagccaaccagaatgccgccaacatcctccggcttaaggagagcattgctgcaaccaatgaagctgtgcatgaggtcaccgacggattatcgcaactagcagtggcagttgggaagatgcagcagtttgttaatgaccaatttaataatacggcgcgagaattggactgtatcaaaattacacaacaagtcggtatagaactcaacctatacctaactgagttgactacagtgttcgggccacaaatcacttcccctgccctaactcagctgactatccaggcactttataatttagctggtggcaacatggattacttgttgactaagttaggcgtagg

SEQ ID NO: 12 - protein, 364 aa, Newcastle disease virus
MDSSRTIGLYFDSALPSSNLLAFPIVLQDTGDGKKQFAPQYRIQRLDSWTDSKEDSVFITTYGFIFQVGDEEATVGMINDEPKRELLSAAMLCLGSVPNVGDLVELARACLTMAVTCKKSATNTERMVFSVVQAPQVLQSCRVVANKYSSVNAVKHVKAPEKIPGSGTLEYKVNFVSLTVVPRKDVYKIPTAALKVSGSSLYNLALNVTIDVEVDPKSPLVKSLSKSDSGYYANLFLHIGLMSTVDKKGKKVTFDKLEKKIRRLDLSVGLSDVLGPSVLVKARGARTKLMAPFFSSSGTACYPIANASPQVAKILWSQTAHLRSVKVIIQAGTQRAVAVTADHEATSTKLEKGHTHSKYNPFKK

SEQ ID NO: 13 - DNA, 1095 bp, Newcastle disease virus
atggactcatctaggacaatcggactgtactttgattctgcccttccttctagcaacttgttagcattcccgatcgtcctacaggacacaggagatggaaagaagcaattcgccccgcaatataggatccagcgtcttgactcgtggaccgatagtaaagaagactcagtattcatcacaacctatggattcatcttccaggtcggggatgaggaagccactgtcggtatgatcaatgatgaacccaagcgcgagttactttctgctgcgatgctctgtctaggaagtgtcccaaacgtcggagatctcgttgagctggcaagggcctgtctcaccatggcagtcacatgcaagaagagtgcaactaatactgagaggatggttttctcagtggtgcaggcaccacaagtgctgcagagctgcagggttgtggcaaataaatattcgtcagtgaatgctgttaagcacgtgaaggcgccagagaagatccctggaagcgggaccctagagtacaaggtgaactttgtctccttgaccgtggtaccgagaaaggatgtctacaagatcccaaccgcagcattgaaggtttctggttcgagtctgtataatcttgcgctcaatgtcaccattgatgtggaggtggatccgaagagcccgttggttaaatcgctatctaagtctgacagtggctattacgctaatctcttcttgcatattggacttatgtccactgtagataagaaggggaagaaagtgacatttgacaaattggaaaagaagataaggagacttgatctatctgtcgggctcagtgacgtgcttggaccttccgtgttggtgaaggcaagaggtgcacggaccaaattgatggcacctttcttctccagtagtggaacagcctgctaccccatagcgaatgcctctcctcaggtagccaagatactctggagtcaaaccgcgcacctgcggagtgtgaaagtcatcatccaagcaggcacccaacgcgccgtcgcagtgactgctgaccacgaggctacatccaccaagctggaaaaggggcatacccattccaaatacaatcctttcaagaaatag

SEQ ID NO: 14 - DNA, 6159 bp, Baculovirus expression vector pUltraBac-1
ttctctgtcacagaatgaaaatttttctgtcatctcttcgttattaatgtttgtaattgactgaatatcaacgcttatttgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggtagacctcggccgtcgcggcgcttgccggtggtgctgaccccggatgaagtggttcgcatcctcggttttctggaaggcgagcatcgtttgttcgcccaggactctagctatagttctagtggttggcctacgtacccgtagtggctatggcagggcttgccgccccgacgttggctgcgagccctgggccttcacccgaacttgggggttggggtggggaaaaggaagaaacgcgggcgtattggtcccaatggggtctcggtggggtatcgacagagtgccagccctgggaccgaaccccgcgtttatgaacaaacgacccaacacccgtgcgttttattctgtctttttattgccgtcatagcgcgggttccttccggtattgtctccttccgtgtttcagttagcctcccccatctcccggtaccgcatgctatgcatcggccgctttacttgtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccatggctcgagatcccgggcgtttaaattgtgtaatttatgtagctgtaatttttaccttattaatattttttacgctttgcattcgacgactgaactcccaaatatatgtttaactcgtcttggtcgtttgaatttttgttgctgtgtttcctaatattttccatcaccttaaatatgttattgtaatcctcaatgttgaacttgcaattggacacggcatagttttccatagtcgtgtaaaacatggtattggctgcattgtaatacatccgactgagcgggtacggatctatgtgtttgagcagcctgttcaaaaactctgcatcgtcgcaaaacggaatttggtacccgggcgtatactccggaatattaatagatcatggagataattaaaatgataaccatctcgcaaataaataagtattttactgttttcgtaacagttttgtaataaaaaaacctataaatattccggattattcataccgtcccaccatcgggcgccatggatcccggtccgaagcgcgcggaattcaaaggcctacgtcgacgagctcactagtcgcggccgctttcgaatctagagcctgcagtctcgacaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgcttgagcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctacttt

SEQ ID NO: 15 - protein, 570 aa, Newcastle disease virus
MNRAVCQVALENDEREAKNTWRLVFRIAILLLTVMTLAISAAALAYSMEASTPGDLVSIPTAISRAEGKITSALGSNQDVVDRIYKQVALESPLALLNTESIIMNAITSLSYQINGAANNSGCGAPVHDPDYIGGIGKELIVDDTSDVTSFYPSAFQEHLNFIPAPTTGSGCTRIPSFDMSATHCYTHNVIFSGCRHHSHSHQYLALGVLRTSATGRVFFSTLRSINLDDTQNRKSCSVSATPLGCDMLCSKVTETEEQDYNSVIPTSMVHGRLGFDGQYHEKDLDVTTLFGDWVANYPGVGGGSFIDNRVWFPVYGGLKPSSPSDTGQEGRYVIYKRYNDTCPDEQDYQIRMAKSSYKPGRFGGKRVQQAILSIKVSTSLGEDPVLTIPPNTVTLMGAEGRVLTVGTSHFLYQRGSSYFSPALLYPMTVNNNTATLHSPYTFNAFTRPGSVPCQASARCPNSCVTGVYTDPYPLVFHRNHTLRGVFGTMLDDEQARLNLVSAVFDNISRSRITRVSSSRTKAAYTTSTCFKVVKTNKTYCLSIAEISNTLFGEFRIVPLLVEILKDDGV

SEQ ID NO: 16 - DNA, 1993 bp, Newcastle disease virus
acgggtagaacggtcggagaggccacccctcaatcgggagtcggacctcacaacttccattctgccgcatcaccagtagcggtcttcagtcatgaaccgcgcagtttgccaagttgcgctagagaatgatgaaagggaagcgaagaatacatggcgcttggtattccggatcgcaatcttacttttaacagtaatgaccttagccatctctgcagccgccctggcatatagtatggaggctagcacacctggcgaccttgtaagcataccaactgcgatctctagggcagagggaaagattacatctgcactcggttccaatcaggatgtagtagataggatatacaagcaggtggctcttgaatctccgttggcattgctaaacaccgaatctataattatgaatgcaataacatccctctcttatcaaatcaatggagctgcaaataacagcgggtgtggggcacctgttcatgacccagattacatcggggggataggtaaagaacttattgtggatgatactagtgatgtcacatcattctatccctctgcgttccaagaacacctgaattttatcccggcacccactacaggatcaggttgcactcggataccctcattcgacatgagtgctacccactgttatactcacaatgtgatattttctggttgcagacaccattcacactcacatcagtatttagcactgggtgtgcttcggacatctgcaacagggagggtattcttttctaccctgcgttccatcaatttggatgacacccaaaatcggaagtcttgcagtgtgagtgcaactcccttaggttgtgatatgctgtgctctaaagtcacagagactgaggaacaggattataattcagttatccccacatcgatggtacatggaaggttagggtttgacggccaataccatgagaaggacctagacgtcacaacattatttggggactgggtggcaaattacccaggagtgggaggtgggtcttttattgacaaccgcgtatggttcccagtctacggagggctaaaacccagttcgcctagtgacactggacaagaagggagatatgtaatatataagcgatacaatgacacatgcccagatgagcaagattaccagattcggatggctaagtcttcgtataagcctgggcggtttggtggaaagcgtgtacagcaggccatcttatctatcaaggtgtcaacatccttgggtgaggacccggtgctgactataccgcccaacacagtcacactcatgggggccgaaggcagagttctcacagtagggacatctcatttcttgtaccagcgagggtcatcatatttctctcctgctttattataccctatgacagtcaacaacaacacagccactcttcatagtccttatacattcaatgctttcactcggccaggtagtgtcccttgccaggcttcagcaagatgccctaactcatgtgtcactggggtctatactgatccatatcccttagtcttccataggaaccacaccttgcgaggggtattcgggacaatgcttgatgatgaacaagcaagactcaaccttgtatctgcagtatttgataacatatcccgcagtcgcataacccgggtaagttcaagcagaaccaaggcagcatacacgacatcaacgtgttttaaagttgtcaagaccaataaaacctattgcctcagcattgcagaaatatccaataccctctttggggaattcaggatcgtccctttactagttgagattctcaaggatgatggggtttagaaagccaggtctagccggttgagccaactgtgagagggttggaaagatgacattgtgtcacctatcttttgtagcgccaagaatcaaactgaataccggccacgagctcgaatcctccgctgccagtcggtcataatcactagtgctaatgtgattagtctgaatcttgtcgatagtcacttgattaag

SEQ ID NO: 17 - protein, 577 aa, Newcastle disease virus
MDRAVSQVALENDEREAKNTWRLIFRIAILFLTVVTLAISVASLLYSMGASTPSDLVGIPTRISRAEEKITSTLGSNQDVVDRIYKQVALESPLALLNTETTIMNAITSLSYQINGAANNSGWGAPIHDPDYIGGIGKELIVDDASDVTSFYPSAFQEHLNFIPAPTTGSGCTRIPSFDMSATHYCYTHNVILSGCRDHSHSHQYLALGVLRTSATGRVFFSTLRSINLDDTQNRKSCSVSATPLGCDMLCSKATETEEEDYNSAVPTRMVHGRLGFDGQYHEKDLDVTTLFGDWVANYPGVGGGSFIDSRVWFSVYGGLKPNTPSDTVQEGKYVIYKRYNDTCPDEQDYQIRMAKSSYKPGRFGGKRIQQAILSIKVSTSLGEDPVLTVPPNTVTLMGAEGRILTVGTSHFLYQRGSSYFSPALLYPMTVSNKTATLHSPYTFNAFTRPGSIPCQASARCPNSCVTGVYTDPYPLIFYRNHTLRGVFGTMLDGEQARLNPASAVFDSTSRSRITRVSSSSIKAAYTTSTCFKVVKTNKTYCLSIAEISNTLFGEFRIVPLLVEILKDDGVREARSG

SEQ ID NO: 18 - DNA, 1734 bp, Newcastle disease virus
atggaccgcgccgttagccaagttgcgttagagaatgatgaaagagaggcaaaaaatacatggcgcttgatattccggattgcaatcttattcttaacagtagtgaccttggctatatctgtagcctcccttttatatagcatgggggctagcacacctagcgatcttgtaggcataccgactaggatttccagggcagaagaaaagattacatctacacttggttccaatcaagatgtagtagataggatatataagcaagtggcccttgagtctccattggcattgttaaatactgagaccacaattatgaacgcaataacatctctctcttatcagattaatggagctgcaaacaacagcgggtggggggcacctattcatgacccagattatataggggggataggcaaagaactcattgtagatgatgctagtgatgtcacatcattctatccctctgcatttcaagaacatctgaattttatcccggcgcctactacaggatcaggttgcactcgaataccctcatttgacatgagtgctacccattactgctacacccataatgtaatattgtctggatgcagagatcactcacactcacatcagtatttagcacttggtgtgctccggacatctgcaacagggagggtattcttttctactctgcgttccatcaacctggacgacacccaaaatcggaagtcttgcagtgtgagtgcaactcccctgggttgtgatatgctgtgctcgaaagccacggagacagaggaagaagattataactcagctgtccctacgcggatggtacatgggaggttagggttcgacggccaatatcacgaaaaggacctagatgtcacaacattattcggggactgggtggccaactacccaggagtagggggtggatcttttattgacagccgcgtatggttctcagtctacggagggttaaaacccaatacacccagtgacactgtacaggaagggaaatatgtgatatacaagcgatacaatgacacatgcccagatgagcaagactaccagattcgaatggccaagtcttcgtataagcctggacggtttggtgggaaacgcatacagcaggctatcttatctatcaaagtgtcaacatccttaggcgaagacccggtactgactgtaccgcccaacacagtcacactcatgggggccgaaggcagaattctcacagtagggacatcccatttcttgtatcagcgagggtcatcatacttctctcccgcgttattatatcctatgacagtcagcaacaaaacagccactcttcatagtccttatacattcaatgccttcactcggccaggtagtatcccttgccaggcttcagcaagatgccccaactcgtgtgttactggagtctatacagatccatatcccctaatcttctatagaaaccacaccttgcgaggggtattcgggacaatgcttgatggtgaacaagcaagacttaaccctgcgtctgcagtattcgatagcacatcccgcagtcgcataactcgagtgagttcaagcagcatcaaagcagcatacacaacatcaacttgttttaaagtggtcaagaccaataagacctattgtctcagcattgctgaaatatctaatactctcttcggagaattcagaatcgtcccgttactagttgagatcctcaaagatgacggggttagagaagccaggtctggctag

SEQ ID NO: 19 - protein, 553 aa, Newcastle disease virus
MGPRSSTRIPIPLMLTIRIALALSCVHLASSLDGRPLAAAGIVVTGDKAVNIYTSSQTGSIIVKLLPNMPKDKEACAKAPLEAYNRTLTTLLTPLGDSIRRIQESVTTSGGRRQKRFIGAIIGSVALGVATAAQITAASALIQANQNAANILRLKESITATNEAVHEVTDGLSQLAVAVGKMQQFVNDQFNNTAQELDCIKITQQVGVELNLYLTELTTVFGPQITSPALTQLTIQALYNLAGGNMDYLLTKLGVGNNQLSSLIGSGLITGNPILYDSQTQLLGIQVTLPSVGNLNNMRATYLETLSVSTTKGFASALVPKVVTQVGSVIEELDTSYCIETDLDLYCTRIVTFPMSPGIYSCLNGNTSACMYSKTEGALTTPYMTLKGSVIANCKMTTCRCADPPGIISQNYGEAVSLIDRHSCNVLSLDGITLRLSGEFDATYQKNISILDSQVIVTGNLDISTELGNVNNSISNALDKLEESNSKLDKVNVKLTSTSALITYIALTAISLVCGILSLVLACYLMYKQKAQQKTLLWLGNNTLGQMRATTKM

SEQ ID NO: 20 - DNA, 1759 bp, Newcastle disease virus
acgggtagaagagtttggatcccggttggcgcattcaaggcgcaagatgggccccagatcttctaccaggatcccaatacctctgatgttgaccatccggatcgcgctggcactgagttgtgtccatctggcaagttctcttgatggcaggcctcttgcagctgcagggatcgtggtaacaggggataaagcagtcaacatatacacctcatcccagacagggtcaatcatagtcaagttactcccaaatatgcccaaggataaagaggcgtgtgcaaaagccccgttggaggcatacaacaggacactgactactttgctcaccccccttggtgattctatccgcaggatacaagagtctgtgactacatccggaggaaggagacagaaacgctttataggtgctattatcggcagtgtagctcttggggttgcaacagctgcacagataacagcagcctcggccctgatacaagccaatcagaatgctgccaacatcctccggcttaaggagagcattactgcaaccaatgaagctgtacatgaggtcactgacggattatcacaactagcagtggcagttgggaagatgcagcagtttgttaatgaccagtttaataacacagctcaggaattggactgtataaaaattacacagcaggttggtgtagaactcaacctgtacctaactgaattgactacagtattcgggccacaaataacttcccctgccttaactcagctgactatccaggcgctttacaacctagctggtggtaatatggattacttgttgactaagttaggtgtagggaacaaccaactcagctcattaattggtagcggcttgatcaccggcaaccctattctgtacgactcacagactcaactcttgggtatacaggtaactttaccctcagtcggaaacctaaataatatgcgtgccacctacctggagaccttgtctgtaagcacaaccaagggatttgcctcagcactcgtcccaaaagtggtgacacaggtcggttctgtgatagaagaacttgacacttcatactgtatagagaccgatttggatttgtattgtacaagaatagtgacattccctatgtctcctggtatttattcctgtttgaacggcaatacatcggcttgcatgtattcaaagactgaaggcgcacttactacgccatacatgactctcaaaggctcagttattgccaattgcaagatgacaacatgcagatgtgcagaccccccgggtatcatatcgcaaaattatggagaagctgtgtctctaatagataggcactcatgcaatgtcttatccttggacgggataactttgaggctcagtggggaatttgatgcaacttatcaaaagaatatctcaatactagattctcaagtaatagtgacaggcaatctcgatatctcaactgagcttgggaatgtcaacaactcgataagtaatgctttggataagttagaggaaagcaacagcaaactagacaaagtcaatgtcaaactgaccagcacatctgctctcattacctatatcgctttaactgccatatctcttgtttgcggtatacttagtctggttctagcatgctacctaatgtacaagcaaaaggcgcaacaaaagaccttgttatggcttgggaataataccctgggtcagatgagagccactacaaaaatgtgaatgcagatgagaggcggaggtatccccaatagcaatttgtgtgcaaattct

SEQ ID NO: 21 - protein, 553 aa, Newcastle disease virus
MGSRPFTKNPAPMMLTIRVALVLSCICPANSIDGRPFAAAGIVVTGDKAVNIYTSSQTGSIIVKLLPNLPKDKEACAKAPLDAYNRTLTTLLTPLGDSIRRIQESVTTSGGGRQGRLIGAIIGGVALGVATAAQITAAAALIQAKQNAANILRLKESIAATNEAVHEVTDGLSQLAVAVGKMQQFVNDQFNKTAQELDCIKIAQQVGVELNLYLTELTTVFGPQITSPALNKLTIQALYNLAGGNMDYLLTKLGIGNNQLSSLIGSGLITGNPILYDSQTQLLGIQVTLPSVGNLNNMRATYLETLSVSTTRGFASALVPKVVTQVGSVIEELDTSYCIETDLDLYCTRIVTFPMSPGIYSCLSGNTSACMYSKTEGALTTPYMTIKGSVIANCKMTTCRCVNPPGIISQNYGEAVSLIDKQSCNVLSLGGITLRLSGEFDVTYQKNISIQDSQVIITGNLDISTELGNVNNSISNALNKLEESNRKLDKVNVKLTSTSALITYIVLTIISLVFGILSLILACYLMYKQKAQQKTLLWLGNNTLDQMRATTKM

SEQ ID NO: 22 - protein, 489 aa, Newcastle disease virus
MSSVFDEYEQLLAAQTRPNGAHGGGEKGSTLKVDVPVFTLNSDDPEDRWSFVVFCLRIAVSEDANKPLRQGALISLLCSHSQVMRNHVALAGKQNEATLAVLEIDGFANGTPQFNNRSGVSEERAQRFAMIAGSLPRACSNGTPFVTAGAEDDAPEDITDTLERILSIQAQVWVTVAKAMTAYETADESETRRINKYMQQGRVQKKYILYPVCRSTIQLTIRQSLAVRIFLVSELKRGRNTAGGTSTYYNLVGDVDSYIRNTGLTAFFLTLKYGINTKTSALALSSLSGDIQKMKQLMRLYRMKGDNAPYMTLLGDSDQMSFAPAEYAQLYSFAMGMASVLDKGTGKYQFAKDFMSTSFWRLGVEYAQAQGSSINEDMAAELKLTPAARRGLAAAAQRVSEVTSSIDMPTQQVGVLTGLSEGGSQALQGGSNRSQGQPEAGDGETQFLDLMRAVANSMREAPNSAQGTPQSGPPPTPGPSQDNDTDWGY

SEQ ID NO: 23 - DNA, 1535 bp, Newcastle disease virus
gccaaaatgtcttccgtattcgacgagtacgaacagctcctcgcggctcagactcgccccaatggagctcatggagggggggagaaagggagtaccttaaaagtagacgtcccggtattcactcttaacagtgatgacccagaagataggtggagctttgtggtattctgcctccggattgctgttagcgaagatgccaacaaaccactcaggcaaggtgctctcatatctcttttatgctcccactcacaggtaatgaggaaccatgttgcccttgcagggaaacagaatgaagccacattggccgtgcttgagattgatggctttgccaacggcacgccccagttcaacaataggagtggagtgtctgaagagagagcacagagatttgcgatgatagcaggatctctccctcgggcatgcagcaacggcaccccgttcgtcacagccggggctgaagatgatgcaccagaagacatcaccgataccctggagaggatcctctctatccaggctcaagtatgggtcacagtagcaaaagccatgactgcgtatgagactgcagatgagtcggaaacaaggcgaatcaataagtatatgcagcaaggcagggtccaaaagaaatacatcctctaccccgtatgcaggagcacaatccaactcacgatcagacagtctcttgcagtccgcatctttttggttagcgagctcaagagaggccgcaacacggcaggtggtacctctacttattataacctagtaggggacgtagactcatatatcaggaataccgggcttactgcattcttcttgacactcaagtacggaatcaacaccaagacatcagcccttgcacttagtagcctctcaggcgacatccagaagatgaagcagctcatgcgtttgtatcggatgaaaggagataatgcgccgtacatgacattacttggtgatagtgaccagatgagctttgcgcctgccgagtatgcacaactttactcctttgccatgggtatggcatcagtcctagataaaggtactgggaaataccaatttgccaaggactttatgagcacatcattctggagacttggagtagagtacgctcaggctcagggaagtagcattaacgaggatatggctgccgagctaaagctaaccccggcagcaaggaggggcctggcagctgctgcccaacgagtctccgaggtgaccagcagcatagacatgcctactcaacaagtcggagtcctcactgggcttagcgaggggggatcccaagccctacaaggcggatcgaatagatcgcaagggcaaccagaagccggggatggggagacccaattcctggatctgatgagagcggtagcaaatagcatgagggaggcgccaaactctgcacagggcactccccaatcggggcctcccccaactcctgggccatcccaagataacgacaccgactgggggtattgattgacaaaacccagcctgcttctacaagaacatcccaatgctctcacccgtagtcgacc

SEQ ID NO: 24 - protein, 364 aa, Newcastle disease virus
MDSSRTIGLYFDSALPSSNLLAFPIVLQDIGDGKKQIAPQYRIQRLDSWTDSKEDSVFITTYGFIFQVGNEEVTVGMISDNPKHELLSAAMLCLGSVPNVGDLVELARACLTMVVTCKKSATDTERMVFSVVQAPQVLQSCRVVANKYSSVNAVKHVKAPEKIPGSGTLEYKVNFVSLTVVPRKDVYKIPTAALKVSGSSLYNLALNVTIDVEVDPKSPLVKSLSKSDSGYYANLFLHIGLMSTVDKKGKKVTFDKLERKIRRLDLSVGLSDVLGPSVLVKARGARTRLLAPFFSSSGTACYPISNASPQVAKILWSQTARLRSVKVIIQAGTQRAVAVTADHEVTSTKIEKRHTIAKYNPFKK

SEQ ID NO: 25 - DNA, 1210 bp, Newcastle disease virus
acgggtagaatcggagtgccctgattgtgccaagatggactcatctaggacaatagggctatactttgattctgcccttccttctagcaacctgttagcattcccgatcgtcctacaagacataggagatgggaagaagcaaatcgccccgcaatataggatccagcgtcttgactcgtggacagacagtaaagaagactcggtattcatcaccacctatggattcatcttccaggttgggaatgaagaagtcactgtcggcatgatcagcgataatcccaagcacgagttactttcagctgcgatgctctgcctaggaagtgtcccgaatgtcggagatcttgttgagttggcaagggcctgcctcactatggtggtaacatgcaagaagagtgcaactgatactgagagaatggtcttctcggtagtacaggcgccccaggtgctgcaaagctgtagggtcgtggcaaacaaatactcgtcagtgaatgcagttaagcacgtgaaagcaccagagaagatccctgggagcggaaccctagagtacaaggtgaattttgtctctttgactgtggtgccaaggaaggatgtctacaaaatcccaaccgcagcattgaaggtatctggctcgagcctgtacaatcttgcgctcaatgtcactattgatgtggaggtagacccaaagagcccgttagtcaaatctctttcaaagtccgacagtggatactatgctaatcttttcttacatatcggacttatgtccactgtagataagaagggaaagaaagtgacatttgacaagctggagaggaagataagaagactcgatttatctgtcgggctcagtgatgtgctcggaccttccgtgcttgtgaaggcgagaggtgcacggactaggctgctggcacctttcttctctagcagtgggacagcctgctatcctatatcaaatgcctctcctcaggtagctaagatactctggagtcaaactgcgcgcctgcggagtgtaaaagtcattattcaagcgggcacccaacgcgctgtcgcggtgaccgctgaccacgaggtcacctctactaagatagaaaagaggcataccattgctaaatacaatccttttaagaaataagctgcatctctgagactgcaatccgcccgctttcccgaatcatcacgacgcttaataatggatctgtcctgattactcaca

SEQ ID NO: 26 - protein, 364 aa, Newcastle disease virus
MDSSRTIGLYFDSAHSSSNLLAFPIVLQDTGDGKKQIAPQYRIQRLDSWTDSKEDSVFITTYGFIFQVGNEEATVGMIDDKPKRELLSAAMLCLGSVPNTGDLVELTRACLTMMVTCKKSATNTERMVFSVVQAPQVLQSCRVVPNKYSSVNAVKHVKAPEKIPGSGTLEYKVNFVSLTVVPKKDVYKIPAAVLKISGSSLYNLALNVTINVEVDPRSPLVKSLSKSDSGYYANLFLHIGLMTTVDRKGKKVTFDKLEKKIRSLDLSVGLSDVLGPSVLVKARGARTKLLAPFFSSSGTACYPIANASPQVAKILWSQTACLRSVKIIIQAGTQRAVAVTADHEVTSTKLEKGHTLAKYNPFKK

SEQ ID NO: 27 - DNA, 1223 bp, Newcastle disease virus
tgtgccaagatggactcatctaggacaattgggctgtactttgattctgcccattcttctagcaacctgttagcatttccgatcgtcctacaagacacaggagatgggaagaagcaaatcgccccgcaatataggatccagcgccttgactcgtggactgatagtaaggaagactcagtattcatcaccacctatggattcatctttcaagttgggaatgaggaagccactgtcggcatgatcgatgataaacccaagcgcgagttactttccgctgcgatgctctgcctaggaagcgtcccaaataccggagaccttgttgagctgacaagggcctgtctcactatgatggtcacatgcaagaagagtgcaactaatactgagagaatggttttctcagtagtgcaggcaccccaagtgctgcaaagctgtagggttgtgccaaacaaatactcatcagtgaatgcagtcaagcacgtgaaagcgccagagaagatccccgggagtggaaccctagaatacaaggtgaactttgtctccttgactgtggtaccgaagaaggatgtctacaagatcccagctgcagtattgaagatttctggctcgagtctgtacaatcttgcgctcaatgtcactattaatgtggaggtagacccgaggagtcctttggttaaatctctgtctaagtctgacagcggatactatgctaacctcttcttgcatattggacttatgaccaccgtagataggaaggggaagaaagtgacatttgacaagctggaaaagaaaataaggagccttgatctatctgtcgggctcagtgatgtgctcgggccttccgtgttggtaaaagcaagaggtgcacggactaagcttttggcacctttcttctctagcagtgggacagcctgctatcccatagcaaatgcttctcctcaggtggccaagatactctggagccaaaccgcgtgcctgcggagcgttaaaatcattatccaagcaggtacccaacgcgctgtcgcagtgaccgctgaccacgaggttacctctactaagctggagaaggggcacacccttgccaaatacaatccttttaagaaataagctgcgtctctgagattgcgctccgcccactcacccagatcatcatgacacaaaaaactaatctgtcttgattatttacagttagtttacctgtccatcaagttagaaaaaacacgggt

SEQ ID NO: 28 - DNA, 15186 bp, Newcastle disease virus B1
accaaacagagaatcggtgagttacgataaaaggcgaaggagcaattgaagtcgcacgggtagaaggtgtgaatctcgagtgcgagcccgaagcacaaactcgaggaagccttctgccaacatgtcttccgtattcgacgagtacgaacagctcctcgcggctcagactcgccccaatggagctcatggagggggggagaaagggagtaccttaaaagtagacgtcccggtattcactcttaacagtgatgacccagaagataggtggagctttgtggtattctgcctccggattgctgttagcgaagatgccaacaaaccactcaggcaaggtgctctcatatctcttttatgctcccactcacaggtaatgaggaaccatgttgcccttgcagggaaacagaatgaagccacattggccgtgcttgagattgatggctttgccaacggcacgccccagttcaacaataggagtggagtgtctgaagagagagcacagagatttgcgatgatagcaggatctctccctcgggcatgcagcaacggcaccccgttcgtcacagccggggctgaagatgatgcaccagaagacatcaccgataccctggagaggatcctctctatccaggctcaagtatgggtcacagtagcaaaagccatgactgcgtatgagactgcagatgagtcggaaacaaggcgaatcaataagtatatgcagcaaggcagggtccaaaagaaatacatcctctaccccgtatgcaggagcacaatccaactcacgatcagacagtctcttgcagtccgcatctttttggttagcgagctcaagagaggccgcaacacggcaggtggtacctctacttattataacctagtaggggacgtagactcatatatcaggaataccgggcttactgcattcttcttgacactcaagtacggaatcaacaccaagacatcagcccttgcacttagtagcctctcaggcgacatccagaagatgaagcagctcatgcgtttgtatcggatgaaaggagataatgcgccgtacatgacattacttggtgatagtgaccagatgagctttgcgcctgccgagtatgcacaactttactcctttgccatgggtatggcatcagtcctagataaaggtactgggaaataccaatttgccaaggactttatgagcacatcattctggagacttggagtagagtacgctcaggctcagggaagtagcattaacgaggatatggctgccgagctaaagctaaccccggcagcaaggaggggcctggcagctgctgcccaacgagtctccgaggtgaccagcagcatagacatgcctactcaacaagtcggagtcctcactgggcttagcgaggggggatcccaagccctacaaggcggatcgaatagatcgcaagggcaaccagaagccggggatggggagacccaattcctggatctgatgagagcggtagcaaatagcatgagggaggcgccaaactctgcacagggcactccccaatcggggcctcccccaactcctgggccatcccaagataacgacaccgactgggggtattgattgacaaaacccagcctgcttctacaagaacatcccaatgctctcacccgtagtcgacccctcgatttgcggctctatatgaccacaccctcaaacaaacatccccctctttcctccctccccctgctgtacaactccgcacgccctaggcaacagaggcacaatgcggctcactaacaatcaaaacagagccgagggaattagaaaaaagtacgggtagaagagggatattcagagatcagggcaagtctcccgagtctctgctctctcctctacctgatagaccaggacaaacatggccacctttacagatgcagagatcgacgagctatttgagacaagtggaactgtcattgacaacataattacagcccagggtaaaccagcagagactgttggaaggagtgcaatcccacaaggcaagaccaaggtgctgagcgcagcatgggagaagcatgggagcatccagccaccggccagtcaagacaaccccgatcgacaggacagatctgacaaacaaccatccacacccgagcaaacgaccccgcatgacagcccgccggccacatccgctgaccagccccccacccaggccacagacgaagccgtcgacacacagctcaggaccggagcaagcaactctctgctgttgatgcttgacaagctcagcaataaatcgtccaatgctaaaaagggcccatggtcgagcccccaagaggggaatcaccaacgtccgactcaacagcaggggagtcaacccagtcgcggaaacagtcaggaaagaccgcagaaccaagtcaaggccgcccctggaaaccagggcacagacgtgaacacagcatatcatggacaatgggaggagtcacaactatcagctggtgcaacccctcatggtctccgatcaaagcagagccaaaacaatacccctgtttctgcggatcatttccacccacctgtagactttgtgcaagcgatgatgtctattatggaggggatttcccaaagagtaagtaaggttgcctatcaggtagatcttgtttttaaacagacatcctccatccctatgatggggtccgaaatccaacagctgaaaacatttgttgcagtcatggaagccaacttgggaatgatgaagattttggatcccggttgtgccaacatttcatctttgagtgatctacgggcagttgcccgatctcacccggttttagtttcaggccctggagacccatctccctatgtgatacaaggaggcgaaatggcacttaataaactttcgcaaccagtgccacatccatctgaattgattaaacccgccactgcatgcgggcctgatataggagtggagagggacactgtccgtgcattgatcatgtcacgcccaatgcacccgagttcttcagccaagctcctaagcaagttagatgcagccgggtcgatcgaggaaatcaggaaaatcaagcgccttgctctaaatggctaattactactgccacacgtagcgggtccctgtccactcggcatcacacggaatctgcaccgagttcccccccgcagacccaaggtccaactctccaagcggcaatcctctctcgcttcctcagccccactgaatgatcgcgcaaccgcaattaatctagctacattaaggattaagaaaaaatacgggtagaattggagtgccccaattgtgccaagatggactcatctaggacaattgggctgtactttgattctgcccattcttctagcaacctgttagcatttccgatcgtcctacaagacacaggagatgggaagaagcaaatcgccccgcaatataggatccagcgccttgacttgtggactgatagtaaggaagactcagtattcatcaccacctatggattcatctttcaagttgggaatgaagaagccactgtcggcattatcgatgataaacccaagcgcgagttactttccgctgcgatgctctgcctaggaagcgtcccaaataccggagaccttattgagctggcaagggcctgtctcactatgatggtcacatgcaagaagagtgcaactaatactgagagaatggttttctcagtagtgcaggcaccccaagtgctgcaaagctgtagggttgtggcaaacaaatactcatcagtgaatgcagtcaagcacgtgaaagcgccagagaagatccccgggagtggaaccctagaatacaaggtgaactttgtctccttgactgtggtaccgaagaaggatgtctacaagatcccagctgcagtattgaagatttctggctcgagtctgtacaatcttgcgctcaatgtcactattaatgtggaggtagacccgaggagtcctttggttaaatctctgtctaagtctgacagcggatactatgctaacctcttcttgcatattggacttatgaccaccgtagataggaaggggaagaaagtgacatttgacaagctggaaaagaaaataaggagccttgatctatctgtcgggctcagtgatgtgctcgggccttccgtgttggtaaaagcaagaggtgcacggactaagcttttggcacctttcttctctagcagtgggacagcctgctatcccatagcaaatgcttctcctcaggtggccaagatactctggagtcaaaccgcgtgcctgcggagcgttaaaatcattatccaagcaggtacccaacgcgctgtcgcagtgaccgctgaccacgaggttacctctactaagctggagaaggggcacacccttgccaaatacaatccttttaagaaataagctgcgtctctgagattgcgctccgcccactcacccagatcatcatgacacaaaaaactaatctgtcttgattatttacagttagtttacctgtccatcaagttagaaaaaacacgggtagaagactctggatcccggttggcgccctccaggtgcaggatgggctccagaccttttaccaagaacccagcacctatgatgctgactatccgggtcgcgctggtattgagttgcatctgtccggcaaactccattgatggcaggccttttgcagctgcaggaattgtggttacaggagacaaagcagtcaacatatacacctcatcccagacaggatcaatcatagttaagctcctcccgaatctgcccaaggataaggaggcatgtgcgaaagcccccttggatgcatacaacaggacattgaccactttgctcaccccccttggtgactctatccgtaggatacaagagtctgtgactacatctggaggggggagacaggggcgccttataggcgccattattggcggtgtggctcttggggttgcaactgccgcacaaataacagcggccgcagctctgatacaagccaaacaaaatgctgccaacatcctccgacttaaagagagcattgccgcaaccaatgaggctgtgcatgaggtcactgacggattatcccaactagcagtggcagttgggaagatgcagcagtttgttaatgaccaatttaataaaacagctcaggaattagactgcataaaaattgcacagcaagttggtgtagagctcaacctgtacctaaccgaattgactacagtattcggaccacaaatcacttcacctgccttaaacaagctgactattcaggcactttacaatctagctggtgggaatatggattacttattgactaagttaggtatagggaacaatcaactcagctcattaatcggtagcggcttaatcaccggtaaccctattctatacgactcacagactcaactcttgggtatacaggtaactctaccttcagtcgggaacctaaataatatgcgtgccacctacttggaaaccttatccgtaagcacaaccaggggatttgcctcggcacttgtcccaaaagtggtgacacaggtcggttctgtgatagaagaacttgacacctcatactgtatagaaactgacttagatttatattgtacaagaatagtaacgttccctatgtcccctggtatttactcctgcttgagcggcaatacatcggcctgtatgtactcaaagaccgaaggcgcacttactacaccatatatgactatcaaaggctcagtcatcgctaactgcaagatgacaacatgtagatgtgtaaaccccccgggtatcatatcgcaaaactatggagaagccgtgtctctaatagataaacaatcatgcaatgttttatccttaggcgggataactttaaggctcagtggggaattcgatgtaacttatcagaagaatatctcaatacaagattctcaagtaataataacaggcaatcttgatatctcaactgagcttgggaatgtcaacaactcgatcagtaatgctttgaataagttagaggaaagcaacagaaaactagacaaagtcaatgtcaaactgaccagcacatctgctctcattacctatatcgttttgactatcatatctcttgtttttggtatacttagcctgattctagcatgctacctaatgtacaagcaaaaggcgcaacaaaagaccttattatggcttgggaataataccctagatcagatgagagccactacaaaaatgtgaacacagatgaggaacgaaggtttccctaatagtaatttgtgtgaaagttctggtagtctgtcagttcggagagttaagaaaaaactaccggttgtagatgaccaaaggacgatatacgggtagaacggtaagagaggccgcccctcaattgcgagccagacttcacaacctccgttctaccgcttcaccgacaacagtcctcaatcatggaccgcgccgttagccaagttgcgttagagaatgatgaaagagaggcaaaaaatacatggcgcttgatattccggattgcaatcttattcttaacagtagtgaccttggctatatctgtagcctcccttttatatagcatgggggctagcacacctagcgatcttgtaggcataccgactaggatttccagggcagaagaaaagattacatctacacttggttccaatcaagatgtagtagataggatatataagcaagtggcccttgagtctccattggcattgttaaatactgagaccacaattatgaacgcaataacatctctctcttatcagattaatggagctgcaaacaacagcgggtggggggcacctattcatgacccagattatataggggggataggcaaagaactcattgtagatgatgctagtgatgtcacatcattctatccctctgcatttcaagaacatctgaattttatcccggcgcctactacaggatcaggttgcactcgaataccctcatttgacatgagtgctacccattactgctacacccataatgtaatattgtctggatgcagagatcactcacactcatatcagtatttagcacttggtgtgctccggacatctgcaacagggagggtattcttttctactctgcgttccatcaacctggacgacacccaaaatcggaagtcttgcagtgtgagtgcaactcccctgggttgtgatatgctgtgctcgaaagccacggagacagaggaagaagattataactcagctgtccctacgcggatggtacatgggaggttagggttcgacggccaatatcacgaaaaggacctagatgtcacaacattattcggggactgggtggccaactacccaggagtagggggtggatcttttattgacagccgcgtatggttctcagtctacggagggttaaaacccaattcacccagtgacactgtacaggaagggaaatatgtgatatacaagcgatacaatgacacatgcccagatgagcaagactaccagattcgaatggccaagtcttcgtataagcctggacggtttggtgggaaacgcatacagcaggctatcttatctatcaaagtgtcaacatccttaggcgaagacccggtactgactgtaccgcccaacacagtcacactcatgggggccgaaggcagaattctcacagtagggacatcccatttcttgtatcagcgagggtcatcatacttctctcccgcgttattatatcctatgacagtcagcaacaaaacagccactcttcatagtccttatacattcaatgccttcactcggccaggtagtatcccttgccaggcttcagcaagatgccccaactcgtgtgttactggagtctatacagatccatatcccctaatcttctatagaaaccacaccttgcgaggggtattcgggacaatgcttgatggtgaacaagcaagacttaaccctgcgtctgcagtattcgatagcacatcccgcagtcgcataactcgagtgagttcaagcagcatcaaagcagcatacacaacatcaacttgttttaaagtggtcaagaccaataagacctattgtctcagcattgctgaaatatctaatactctcttcggagaattcagaatcgtcccgttactagttgagatcctcaaagatgacggggttagagaagccaggtctggctagttgagtcaactatgaaagagttggaaagatggcattgtatcacctatcttctgcgacatcaagaatcaaaccgaatgccggcgcgtgctcgaattccatgtcgccagttgaccacaatcagccagtgctcatgcgatcagattaagccttgtcaatagtctcttgattaagaaaaaatgtaagtggcaatgagatacaaggcaaaacagctcatggtaaataatacgggtaggacatggcgagctccggtcctgaaagggcagagcatcagattatcctaccagagtcacacctgtcttcaccattggtcaagcacaaactactctattattggaaattaactgggctaccgcttcctgatgaatgtgacttcgaccacctcattctcagccgacaatggaaaaaaatacttgaatcggcctctcctgatactgagagaatgataaaactcggaagggcagtacaccaaactcttaaccacaattccagaataaccggagtactccaccccaggtgtttagaagaactggctaatattgaggtccctgattcaaccaacaaatttcggaagattgagaagaagatccaaattcacaacacgagatatggagaactgttcacaaggctgtgtacgcatatagagaagaaactgctggggtcatcttggtctaacaatgtcccccggtcagaggagttcagcagcattcgtacggatccggcattctggtttcactcaaaatggtccacagccaagtttgcatggctccatataaaacagatccagaggcatctgattgtggcagctaggacaaggtctgcggccaacaaattggtgatgctaacccataaggtaggccaagtctttgtcactcctgaacttgttgttgtgacgcatacgaatgagaacaagttcacatgtcttacccaggaacttgtattgatgtatgcagatatgatggagggcagagatatggtcaacataatatcaaccacggcggtgcatctcagaagcttatcagagaaaattgatgacattttgcggttaatagacgctctggcaaaagacttgggtaatcaagtctacgatgttgtatcactaatggagggatttgcatacggagctgtccagctactcgagccgtcaggtacatttgcgggagatttcttcgcattcaacctgcaggagcttaaagacattctaattggcctcctccccaatgatatagcagaatccgtgactcatgcaatcgctactgtattctctggtttagaacagaatcaagcagctgagatgttgtgcctgttgcgtctgtggggtcacccactgcttgagtcccgtattgcagcaaaggcagtcaggagccaaatgtgcgcaccgaaaatggtagactttgatatgatccttcaggtactgtctttcttcaagggaacaatcatcaacggatacagaaagaagaatgcaggtgtgtggccgcgagtcaaagtggatacaatatatgggaaggtcattgggcaactacatgcagattcagcagagatttcacacgatatcatgttgagagagtataagagtttatctgcacttgaatttgagccatgtatagaatacgaccctgtcactaacctgagcatgttcctaaaagacaaggcaatcgcacaccccaacgataattggcttgcctcgtttaggcggaaccttctctccgaagaccagaagaaacatgtaaaggaagcgacttcgactaaccgcctcttgatagagtttttagagtcaaatgattttgatccatataaagagatggaatatctgacgacccttgagtaccttagagatgacaatgtggcagtatcatactcgctcaaagagaaggaagtgaaagttaatggacggatcttcgctaagctgacaaagaagttaaggaactgtcaggtgatggcggaagggatcctagccgatcagattgcacctttctttcagggaaatggagtcattcaggatagcatatccttgaccaagagtatgctagcgatgagtcaactgtcttttaacagcaataagaaacgtatcactgactgtaaagaaagagtatcttcaaaccgcaatcatgatccgaaaagcaagaaccgtcggagagttgcaaccttcataacaactgacctgcaaaagtactgtcttaattggagatatcagacgatcaaattgttcgctcatgccatcaatcagttgatgggcctacctcatttcttcgagtggattcacctaagactgatggacactacgatgttcgtaggagaccctttcaatcctccaagtgaccctactgactgtgacctctcaagagtccctaatgatgacatatatattgtcagtgccagagggggtatcgaaggattatgccagaagctatggacaatgatctcaattgctgcaatccaacttgctgcagctagatcgcattgtcgtgttgcctgtatggtacagggtgataatcaagtaatagcagtaacgagagaggtaagatcagatgactctccggagatggtgttgacacagttgcatcaagccagtgataatttcttcaaggaattaatccatgtcaatcatttgattggccataatttgaaggatcgtgaaaccatcaggtcagacacattcttcatatacagcaaacgaatcttcaaagatggagcaatcctcagtcaagtcctcaaaaattcatctaaattagtgctagtgtcaggtgatctcagtgaaaacaccgtaatgtcctgtgccaacattgcctctactgtagcacggctatgcgagaacgggcttcccaaagacttctgttactatttaaactatataatgagttgtgtgcagacatactttgactctgagttctccatcaccaacaattcgcaccccgatcttaatcagtcgtggattgaggacatctcttttgtgcactcatatgttctgactcctgcccaattagggggactgagtaaccttcaatactcaaggctctacactagaaatatcggtgacccggggactactgcttttgcagagatcaagcgactagaagcagtgggactactgagtcctaacattatgactaatatcttaactaggccgcctgggaatggagattgggccagtctgtgcaacgacccatactctttcaattttgagactgttgcaagcccaaatattgttcttaagaaacatacgcaaagagtcctatttgaaacttgttcaaatcccttattgtctggagtgcacacagaggataatgaggcagaagagaaggcattggctgaattcttgcttaatcaagaggtgattcatccccgcgttgcgcatgccatcatggaggcaagctctgtaggtaggagaaagcaaattcaagggcttgttgacacaacaaacactgtaattaagattgcgcttactaggaggccattaggcatcaagaggctgatgcggatagtcaattattctagcatgcatgcaatgctgtttagagacgatgttttttcctctagtagatccaaccaccccttagtctcttctaatatgtgttctctgacactggcagactatgcacggaatagaagctggtcacctttgacgggaggcaggaaaatactgggtgtatctaatcctgatacgatagaactcgtagagggtgagattcttagtgtaagcggagggtgtacaagatgtgacagcggagatgaacaatttacttggttccatcttccaagcaatatagaattgaccgatgacaccagcaagaatcctccgatgagggtaccatatctcgggtcaaagacacaggagaggagagctgcctcacttgcgaaaatagctcatatgtcgccacatgtgaaggctgccctaagggcatcatccgtgttgatctgggcttatggggataatgaagtaaattggactgctgctctcacgattgcaaaatctcggtgtaatgtaaacttagagtatcttcggttactgtcccctttacccacggctgggaatcttcaacatagactagatgatggtataactcagatgacattcacccctgcatctctctacaggtgtcaccttacattcacatatccaatgattctcaaaggctgttcactgaagaaggagtcaaagaggggaatgtggtttaccaacagagtcatgctcttgggtttatctctaatcgaatcgatctttccaatgacaacaaccagaacatatgatgagatcacactgcacctacatagtaaatttagttgctgtatcagggaagcacctgttgcggttcctttcgagctacttggggtggcaccggaactgaggacagtgacctcaaataagtttatgtatgatcctagccctgtatcggagggagactttgcgagacttgacttagctatcttcaagagttatgagcttaatctggagtcatatcccacgatagagctaatgaacattctttcaatatccagcgggaagttgattggccagtctgtggtttcttatgatgaagatacctccataaagaatgatgccataatagtgtatgacaatacccgaaattggatcagtgaagctcagaattcagatgtggtccgcctatttgaatatgcagcacttgaagtgctcctccaccgttcttaccaactctattacctgagagtaagaggcctagacaatattgtcttatatatgggtgatttatacaagaatatgccaggaattctactttccaacattgcagctacaatatctcatcctgtcattcattcaaggttacatgcagtgggcctggtcaaccatgacggatcacaccaacttgcagatacggattttatcgaaatgtctgcaaaactgttagtatcttgcacccgacgtgtgatctccggcttatattcaggaaataagtatgatctgctgttcccatctgtcttagatgataacctgaatgagaagatgcttcagctgatatcccggttatgctgtctgtacacggtactctttgctacaacaagagaaatcccgaaaataagaggcttaactgcagaagagaaatgttcaatactcactgagtatttactgtcggatgctgtgaaaccattacttagccccgatcaagtgagctctatcatgtctcctaacataattacattcccagctaatctgtactacatgtctcggaagagcctcaatttgatcagggaaagggaggacagggatactatcctggcgttgttgttcccccaagagccattattagagttcccttctgtgcaagatattggtgctcgagtgaaagatccattcacccgacaacctgcggcatttttgcaagagttagatttgagtgctccagcaaggtatgacgcattcacacttagtcagattcatcctgaactcacatctccaaatccggaggaagactacttagtacgatacttgttcagagggatagggactgcatcttcctcttggtataaggcatcccatctcctttctgtacccgaggtaagatgtgcaagacacgggaactccttatacttggctgaaggaagcggagccatcatgagtcttcttgaactgcatgtaccacatgaaactatctattacaatacgctcttttcaaatgagatgaaccccccgcaacgacatttcgggccgaccccaactcagtttttgaattcggttgtttataggaatctacaggcggaggtaacatgcaaggatggatttgtccaagagttccgtccattatggagagaaaatacagaggaaagtgacctgacctcagataaagcagtggggtatattacatctgcagtaccctacagatctgtatcattgctgcattgtgacattgaaattcctccagggtccaatcaaagcttactagatcaactagctatcaatttatctctgattgccatgcattctgtaagggagggcggggtagtaatcatcaaagtgttgtatgcaatgggatactactttcatctactcatgaacttgtttgctccgtgttccacaaaaggatatattctctctaatggttatgcatgtcgaggggatatggagtgttacctggtatttgtcatgggttacctgggcgggcctacatttgtacatgaggtggtgaggatggcaaaaactctggtgcagcggcacggtacgctcttgtctaaatcagatgagatcacactgaccaggttattcacctcacagcggcagcgtgtgacagacatcctatccagtcctttaccaagattaataaagtacttgaggaagaatattgacactgcgctgattgaagccgggggacagcccgtccgtccattttgtgcggaaagtttggtgagcacgctagcgaacataactcagataacccagattatcgctagtcacattgacacagtcatccggtctgtgatatatatggaagctgagggtgatctcgctgacacagtatttctatttaccccttacaatctctctactgacgggaaaaagaggacatcacttaaacagtgcacgagacagatcctagaggttacaatactaggtcttagagtcgaaaatctcaataaaataggcgatataatcagcctagtgcttaaaggcatgatctccatggaggaccttatcccactaaggacatacttgaagcatagtacctgccctaaatatttgaaggctgtcctaggtattaccaaactcaaagaaatgtttacagacacttctgtactgtacttgactcgtgctcaacaaaaattctacatgaaaactataggcaatgcagtcaaaggatattacagtaactgtgactcctaacgaaaatcacatattaataggctccttttttggccaattgtattcttgttgatttaattatattatgttagaaaaaagttgaactctgactccttaggactcgaattcgaactcaaataaatgtctttaaaaaaggttgcgcacaattattcttgagtgtagtctcgtcattcaccaaatctttgtttggt

SEQ ID NO: 29 - protein, 617 aa, Measles virus
MSPQRDRINAFYKDNPHPKGSRIVINREHLMIDRPYVLLAVLFVMFLSLIGLLAIAGIRLHRAAIYTAEIHKSLSTNLDVTNSIEHQVKDVLTPLFKIIGDEVGLRTPQRFTDLVKFISDKIKFLNPDREYDFRDLTWCINPPERIKLDYDQYCADVAAEELMNALVNSTLLEARATNQFLAVSKGNCSGPTTIRGQFSNMSLSLLDLYLSRGYNVSSIVTMTSQGMYGGTYLVEKPNLSSKGSELSQLSMHRVFEVGVIRNPGLGAPVFHMTNYFEQPVSNDFSNCMVALGELKFAALCHREDAITIPYQGSGKGVSFQLVKLGVWKSPTDMQSWVPLSTDDPVIDRLYLSSHRGVIADNQAKWAVPTTRTDDKLRMETCFQQACKGKIQALCENPEWAPLKDNRIPSYGVLSVNLSLTVELKIKIASGFGPLITHGSGMDLYKSNHNNVYWLTIPPMKNLALGVINTLEWVPRFKVSPNLFTVPIKEAGEDCHAPTYLPAEVDGDVKLSSNLVILPGQDLQYVLATYDTSRVEHAVVYYVYSPSRSFSYFYPFRLPIKGFPIELQVECFTWDQKLWCRHFCVLADSESGGHITHSGMVGMGVSCTVTREDGTNRR

SEQ ID NO: 30 - DNA, 1854 bp, Measles virus
atgtcaccacaacgagaccggataaatgccttctacaaagacaacccccatcctaagggaagtaggatagttattaacagagaacatcttatgattgatagaccttatgttttgctggctgttctgttcgtcatgtttctgagcttgatcgggctgctagccattgcaggcattagactgcatcgggcagccatctacaccgcagagatccataaaagcctcagcaccaatctagatgtaactaactcaatcgagcatcaggtcaaggacgtgctgacaccactcttcaagatcattggtgatgaagtgggcctgaggacacctcagagattcactgatctagtgaaattcatctctgacaagattaaattccttaatccggatagggagtacgacttcagagatctcacttggtgtatcaacccgccagagagaatcaaattggattatgaccaatactgtgcagatgtggctgctgaagaactcatgaatgcattggtgaactcaactctactggaagccagggcaaccaatcagttcctagctgtctcaaagggaaactgctcagggcccactacaatcagaggtcaattctcaaacatgtcgctgtccctgttggacttgtatttaagtcgaggttacaatgtgtcatctatagtcactatgacatcccagggaatgtacgggggaacttacctagtggaaaagcctaatctgagcagcaaaggttcggagttgtcacaactgagcatgcaccgagtgtttgaagtaggtgttatcagaaatccgggtttgggggctccggtgttccatatgacaaactattttgagcaaccagtcagtaatgatttcagcaactgcatggtggctttaggagagctcaaattcgcagccctttgtcacagggaggatgctatcacaattccctatcagggatcagggaaaggtgtcagcttccagctcgtcaagctaggtgtctggaaatccccaaccgacatgcaatcctgggtccccctatcaacggatgatccagtgatagacaggctttacctctcatctcacagaggcgttatcgctgacaatcaagcaaaatgggctgtcccgacaacacggacagatgacaagttgcgaatggagacatgcttccagcaggcgtgtaagggtaaaatccaagcactctgcgagaatcccgagtgggcaccattgaaggataacaggattccttcatacggggtcttgtctgttaatctgagtctgacagttgagcttaaaatcaaaattgcttcaggattcgggccattgatcacacacggttcagggatggacctgtacaaatccaaccacaacaatgtgtattggctgactatcccgccaatgaagaacctagccttaggtgtaatcaacacattggagtgggtaccgagattcaaggttagtcccaacctcttcactgttccaatcaaggaagcaggcgaggactgccatgccccaacatacctacctgcggaggtggatggtgatgtcaaactcagttccaatctggtgattctacctggtcaagacctccaatatgttttggcaacctacgatacttccagagttgagcatgctgtggtttattacgtttacagcccaagccgctcattttcttacttttatccttttaggttgcctataaaggggttccccatcgaattacaggtggaatgcttcacttgggaccaaaaactctggtgccgtcacttctgtgtgcttgcggactcagaatctggtggacatatcactcactctgggatggtgggcatgggagttagctgtacagtcactcgagaagatggaaccaaccgcagatag

SEQ ID NO: 31 - protein, 617 aa, Measles virus
MSPQRDRINAFYKDNPHPKGSRIVINREHLMIDRPYVLLAVLFVMFLSLIGLLAIAGIRLHRAAIYTAEIHKSLSTNLDVTNSIEHQVKDVLTPLFKIIGDEVGLRTPQRFTDLVKFISDKIKFLNPDREYDFRDLTWCINPPERIKLDYDQYCADVAAEELMNALVNSTLLEARATNQFLAVSKGNCSGPTTIRGQFSNMSLSLLDLYLSRGYNVSSIVTMTSQGMYGGTYLVEKPNLSSKGSELSQLSMHRVFEVGVIRNPGLGAPVFHMTNYFEQPVSNDFSNCMVALGELKFAALCHREDSITIPYQGSGKGVSFQLVKLGVWKSPTDMQSWVPLSTDDPVIDRLYLSSHRGVIADNQAKWAVPTTRTDDKLRMETCFQQACKGKIQALCENPEWAPLKDNRIPSYGVLSVNLSLTVELKIKIASGFGPLITHGSGMDLYKSNHNNVYWLTIPPMKNLALGVINTLEWVPRLKVSPNLFTVPIKEAGEDCHAPTYLPAEVDGDVKLSSNLVILPGQDLQYVLATYDTSRVEHAVVYYVYSPSRSFSYFYPFRLPIKGVPIELQVECFTWDQKLWCRHFCVLADSETGGHITHSGMVGMGVSCTVTREDGTNRR

SEQ ID NO: 32 - DNA, 1854 bp, Measles virus
atgtcaccacaacgagaccggataaatgccttctacaaagacaacccccatcctaagggaagtaggatagttattaatagagaacatcttatgattgatagaccttatgttttgctggctgttctattcgtcatgtttctgagcttgatcgggctgctagccattgcaggcattagactgcatcgggcagctatctacaccgcagagatccataaaagcctcagcaccaatctagatgtaactaactcaatcgagcatcaggtcaaggacgtgctgacaccactcttcaagatcatcggtgatgaagtgggcctgaggacacctcagagattcactgacctagtgaaattcatctctgacaagattaaattccttaatccggatagggagtacgacttcagagatctcacttggtgtatcaacccgccagagagaatcaaattggattatgaccaatactgtgcagatgtggctgctgaagaactcatgaatgcattggtgaactcaactctactggaggccagggcaaccaatcagttcttagctgtctcaaagggaaactgctcagggcccactacaatcagaggtcaattctcaaacatgtcgctgtccctgttggacttgtatttaagtcgaggttacaatgtgtcatctatagtcactatgacatcccagggaatgtacgggggaacttacctagtggaaaagcctaatctgagcagcaaagggtcagagttgtcacaactgagcatgcaccgggtgtttgaggtaggtgttatcagaaatccgggtttgggggctccagtgttccatatgacaaactattttgagcaaccagtcagtaatgatttcagcaactgcatggtggctttaggggagctcaaattcgcagccctttgtcacagggaggattctatcacaattccctatcaagggtcagggaaaggtgtcagcttccagctcgtcaagctaggtgtctggaaatccccaaccgacatgcaatcctgggtccccctatcaacggatgatccagtgatagacaggctttacctctcatctcacagaggcgttatcgctgacaatcaagcaaaatgggctgtcccgacaacacggacagatgacaagttgcgaatggagacatgcttccagcaggcgtgtaagggtaaaatccaagcactctgcgagaatcccgagtgggcaccattgaaggataacaggattccttcatacggggtcttgtctgttaatctgagtctgacagttgagcttaaaatcaaaattgcttcaggattcgggccattgatcacacacggttcagggatggacctgtacaagtccaaccacaacaatgtgtattggctgactatcccgccaatgaagaacctagccttaggtgtaatcaacacattggaatgggtaccgagactcaaggttagtcccaacctcttcactgttccaatcaaggaggcaggcgaggactgccatgccccgacatacctacctgcggaggtggatggtgatgtcaaactcagttccaatctggtgattctacctggtcaagacctccaatatgttttggcaacctacgatacttctagagttgaacatgctgtggtttattacgtttacagcccaagccgctcattttcttacttttatccttttaggttgcctataaagggggtccccatcgaattacaagtggaatgcttcacatgggaccaaaaactctggtgccgtcacttctgtgtgcttgcggactcagaaactggtggacatatcactcactctgggatggtgggcatgggagtcagctgcacagtcactcgggaagatggaaccaaccgcagatag

SEQ ID NO: 33 - protein, 617 aa, Measles virus
MSLQRDRINAFYKDNPHSKGSRIVINREHLMIDRPYVLLAVLFVMFLSLIGLLAIAGIRLHRAAIYTAEIHKSLSTNLDVTNSIEHQVKDVLTPLFKIIGDEVGLRTPQRFTDLVKFISDKIKFLNPDREYDFRDLTWCINPPERIKLNYDQYCADVAAEELMNALVNSTLLETRTTNQFLAVSKGNCSGPTTIRGQFSNMSLSLLDLYLSRGYNVSSIVTMTSQGMYGGTYLVEKPNLNSKGSELSQLSMYRVFEVGVIRNPGLGAPVFHMTNYFEQPISKDLSNCMVALGELKLAALCHGGDSITIPYQGSGKGVSFQLVKLGVWKSPTDMQSWVPLSTDDPVIDRLYLSSHRGVITDNQANWAVPTTRTDDKLRMETCFQQACKGKIQALCENPEWAPLKDSRIPSYGVLSVDLSLAAEPKIKIASGFGPLITHGSGMDLYKSNHNNVYWLTIPPMKNLALGVINTLEWIPRLKVSPNLFTVPIKEAGENCHAPTYLPAEVDGDVKLSSNLVILPGQDLQYVLATYDTSRVEHAVVYYVYSPSRSFSYFYPFRLPIKGTPIELQVECFTWDQRLWCRHFCVLADSESGGHITHSGMVGMGVSCTVNREDEANRR

SEQ ID NO: 34 - DNA, 1854 bp, Measles virus
atgtcactgcaacgagaccggataaatgccttctacaaagataaccctcattccaaaggaagtaggatagttattaacagagaacatctcatgattgatagaccttatgttttgctggctgttctgttcgtcatgtttctgagcttgatcgggttgctggccattgcaggcattaggcttcatcgggcagctatctacactgcagagatccataaaagcctcagcaccaatctagatgtaactaactcaatcgagcatcaggtcaaggatgtgctgacaccgctcttcaaaatcatcggtgatgaagtgggcctgagaacacctcagagattcactgacctagtgaaattcatctctgacaagatcaaattccttaatccggatagggagtatgacttcagagatctcacttggtgtatcaacccgccagagagaatcaaattgaattatgatcaatactgtgcagatgtggctgctgaagagctcatgaatgcattagtgaactcaactctactggagaccagaacaaccaatcagttcctagctgtctcaaagggaaactgctcagggcccactaccatcagaggtcaattctcaaacatgtcgctgtctctgttagacttatatttaagtcgaggttacaatgtgtcatctatagtcactatgacgtcccagggaatgtatgggggaacttacctagttgaaaagcccaatctgaacagcaaaggatcagaattatcacaactgagcatgtaccgagtgtttgaagtaggtgttataagaaatccaggcttgggggctccggtgttccatatgacaaactattttgaacaaccaatcagcaaggatctcagcaactgcatggtagctttgggggagctcaaactcgcagccctttgtcacgggggagattccatcacaattccctatcagggatcagggaaaggtgtcagcttccaactcgtcaagctaggtgtctggaaatccccaaccgacatgcaatcctgggtccccctatcaacggatgacccagtgatagacaggctctacctctcatctcacagaggtgtcatcactgacaatcaagcaaattgggctgttccgacaacacgaacagatgataagttgcggatggagacatgcttccagcaggcgtgcaagggcaaaatccaagcactctgtgaaaatcccgagtgggcaccgttgaaggacagcaggattccttcatacggggtcttgtctgtcgacctgagtctggcagctgagcccaaaatcaaaattgcttcgggattcggtccattgatcactcacggttcagggatggacctatacaaatccaaccacaacaatgtgtattggctgactatcccgccaatgaagaacttagccttaggtgtaatcaacacattggagtggataccgagactcaaggttagtcccaacctcttcactgtcccaattaaggaagctggcgagaactgccatgccccaacatacctacctgcggaggtggatggtgatgtcaaactcagttccaatctggtgattttacctggtcaagatctccaatatgttttggcaacctacgatacttccagagttgaacatgctgtggtttattacgtttacagcccaagccgctcattctcttacttttatccctttaggttacctataaaggggacccccatcgaattacaagtggaatgcttcacatgggaccaaagactctggtgccgtcacttctgtgtgcttgctgactcggaatctggtggacatatcacccactctgggatggtgggcatgggagtcagctgcacagtcaaccgggaagacgaagccaatcgcagatag

SEQ ID NO: 35 - protein, 550 aa, Measles virus
MGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRPFQSVASSRRHKRFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTYIAADHCPVVEVNGVTIQVGSRRYPDAVYLHRIDLGPPISLERLDVGTNLGNAIAKLEDAKELLESSDQILRSMKGLSSTSIVYILIAVCLGGLIGIPALICCCRGRCNKKGEQVGMSRPGLKPDLTGTSKSYVRSL

SEQ ID NO: 36 - DNA, 2383 bp, Measles virus
cttagggtcaaggaacatacacacccaacagaacccagaccccgacccacggcgccgcgcccccaacccccgacaaccagagggagcccccaaccaatcccgccggctccctcggtgcccacagacaggcacaccaacccccgaacaggcccagtgcccagccatcgacaatctaagacgggggggccccccccaaaaaaagcccccaggggccgacagccagcaccgcgcggaagcccacccaccccacacacgaccacgacaaccaaaccagaatccagaccaccctgggccgccagctcccagactcggccatcaccccgcagaaaggaaagggcacaacccgcgcaccccagccccgatccggcgggcagccacccaacccgaaccggcacccaagagcgatccccgaaggacccccgagccgcaaaggacatcagtatcccacagcctctccaagtcccctggtctcttcctcttctcgaagggaccaaaagatcaatccaccacatccgacgacactcaactccccacccctaaaggagacaccgggagtcctggaatcaagactcatccaatgtccatcatgggtctcaaggtgaacgtctctgccatattcatggcagtactgttaactctccaaacacccaccggtcaaatccattggggcaatctctctaagataggggtggtaggaataggaagtgcaagctacaaagttatgactcgttccagccatcaatcattagtcataaaattaatgcccaatataactctcctcaataactgcacgagggtagagattgcagaatacaggagactactgagaacagttttggaaccaattagagatgcacttaatgcaatgacccagaatataagaccgtttcagagtgtagcttcaagtaggagacacaagagatttgcgggagtagtcctggcaggtgcggccctaggcgttgccacagctgctcagataacagccggcattgcacttcaccagtccatgctgaactctcaagccatcgacaatctgagagcaagtctggaaactactaatcaggcaattgaggcaatcagacaagcagggcaggagatgatattggctgttcagggtgtccaagactacatcaataatgagctgataccgtctatgaaccaactatcttgtgatttaatcggccagaagctcgggctcaaattgctcagatactatacagaaatcctgtcattatttggccctagcttacgggaccccatatctgcggagatatctatccaggctttgagctatgcgctcggaggagatatcaataaggtgttagaaaagctcggatatagcggaggtgatttactgggcatcttagagagcagaggaataaaggcccggataactcacgtcgacacagagtcctacttcattgtcctcagtatagcttatccgacgctgtccgagatcaagggggtgattgtccaccggctcgagggggtctcgtacaacataggctctcaagagtggtatacgactgtgcccaagtatgttgcaacccaagggtaccttatctcgaattttgatgagtcatcgtgtacttttatgccagaggggactgtgtgcagccaaaatgccttgtacccgatgagtcctctgctccaagaatgcctccgggggtccaccaagtcctgtgctcgtacactcgtatctgggtcttttgggaaccggtttattttgtcacaagggaacctaatagccaattgtgcatcgatcctttgcaagtgttacacaacaggaacgatcattaatcaagaccctgacaagatcctaacatacattgctgcagatcactgcccggtagtcgaagtgaacggcgtgaccatccaagtcgggagcaggaggtatccagacgctgtgtacttgcacagaattgacctcggtcctcccatatcattggagaggttggacgtagggacaaatctggggaatgcaattgctaagttggaggatgccaaagaattgttggagtcatcggaccagatattgaggagtatgaaaggtttgtcgagcactagcatagtctacatcctgattgcagtgtgtcttggagggttgatagggatccccgctttaatatgttgctgcagggggcgttgtaacaaaaagggagaacaagttggtatgtcaagaccaggcctaaagcctgatcttacaggaacatcaaaatcctatgtaaggtcgctctgatcctctacaactcttggaacacaaatgtcccacaagtctcctcttcgtcatcaagcaaccaccgcatccagcatcaagcccacctgaaattatctccggcttccctttggccgaacaatatcggcagttaattaaaacttaggg

SEQ ID NO: 37 - protein, 553 aa, Measles virus
MSIMGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTYIAADHCPVVEVNGVTIQVGSRRYPDAVYLHRIDLGPPISLERLDVGTNLGNAIAKLEDAKELLESSDQILRSMKGLSSTSIVYILIAVCLGGLIGIPALICCCRGRCNKKGEQVGMSRPGLKPDLTGTSKSYVRSL

SEQ ID NO: 38 - DNA, 2384 bp, Measles virus
tcgagggccaaggaacatacacacccaacagaacccagaccccggcccacggcgccgcgcccccaacccccgacaaccagagggagcccccaaccaatccgccggctcccccggtgcccacaggcagggacaccaacccccgaacagacccagcacccaaccatcgacaatccaagacgggggggcccccccaaaaaaaaggcccccaggggccgacagccagcaccgcgaggaagcccacccaccccacacacgaccacggcaaccaaaccagaacccagaccaccctgggtcaccagctccagacctcggtcatcaccccgcagaaaggaaaggcacaacccgcgaccccagccccgatccggcggggagccacccaacccgaaccagcacccaagagcgatccccgaaggacccccgaaccgcaaaggacatcagtatcccacagcctctccaagtcccccggtctcctcctcttctcgaagggaccaaaagatcaatccaccaccacacacccgacgacactcaactccccacccctaaaggagacaccgggaatcccagaatcaagactcatccaatgtccatcatgggtctcaaggtgaacgtctctgccatattcatggcagtactgttaactctccaaacacccaccggtcaaatccattggggcaatctctctaagataggggtggtaggaataggaagtgcaagctacaaagttatgactcgttccagccatcaatcattagtcataaaattaatgcccaatataactctcctcaataactgcacgagggtagagattgcagaatacaggagactactgagaacagttttggaaccaattagagatgcacttaatgcaatgacccagaatataagaccggttcagagtgtagcttcaagtaggagacacaagagatttgcgggagtagtcctggcaggtgcggccctaggcgttgccacagctgctcagataacagccggcattgcacttcaccagtccatgctgaactctcaagccatcgacaatctgagagcgagcctggaaactactaatcaggcaattgaggcaatcagacaagcagggcaggagatgatattggctgttcagggtgtccaagactacatcaataatgagctgataccgtctatgaaccaactatcttgtgatttaatcggccagaagctcgggctcaaattgctcagatactatacagaaatcctgtcattatttggccccagcttacgggaccccatatctgcggagatatctatccaggctttgagctatgcgcttggaggagacatcaataaggtgttagaaaagctcggatacagtggaggtgatttactgggcatcttagagagcagaggaataaaggcccggataactcacgtcgacacagagtcctacttcattgtcctcagtatagcctatccgacgctgtccgagattaagggggtgattgtccaccggctagagggggtctcgtacaacataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtccaccaagtcctgtgctcgtacactcgtatccgggtcttttgggaaccggttcattttatcacaagggaacctaatagccaattgtgcatcaatcctttgcaagtgttacacaacaggaacgatcattaatcaagaccctgacaagatcctaacatacattgctgccgatcactgcccggtagtcgaggtgaacggcgtgaccatccaagtcgggagcaggaggtatccagacgctgtgtacttgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtctacatcctgattgcagtgtgtcttggagggttgatagggatccccgctttaatatgttgctgcagggggcgttgtaacaaaaagggagaacaagttggtatgtcaagaccaggcctaaagcctgatcttacgggaacatcaaaatcctatgtaaggtcgctctgatcctctacaactcttgaaacacaaatgttcccacaagtctcctcttcgtcatcaagcaaccaccgcacccagcatcaagcccacctgaaccagctaaattatctccggcttccctctggccgaacaatatcggtagttaatt

SEQ ID NO: 39 - protein, 553 aa, Measles virus
MSIMGLKVNVSAIFMAVLLTLQTPAGQIHWGNLSKIGVVGIGSASYKVMTRSSHQSLVIKLIPNITLLNNCTKVEIAEYRRLLRTVLEPIRDALNAMTQNIRPVQSVASSMRHKRFAGVVLAGAALGVATAAQITAGIALHRSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTYIAADRCPVVEVNGVTIQVGSRRYPDAVYLHRIDLGPPISLERLDVGTNLGNAIAKLEDAKELLESSDQILRSMKGLSSTSIVYILIAVCLGGLIGIPTLICCCRGRCNKKGEQVGMSRPGLKPDLTGTSKSYVRSL

SEQ ID NO: 40 - DNA, 1662 bp, Measles virus
atgtccatcatgggtctcaaggtgaacgtctctgccatattcatggcagtactgttaactctccaaacacccgccggtcaaatccattggggcaatctctctaagataggggtagtaggaataggaagtgcaagctacaaagttatgactcgttccagccatcaatcattagtcataaaattaattcccaatataactctcctcaataactgcacgaaggtagagattgcagagtacaggagactactaagaacagttttggaaccaattagagatgcacttaatgcaatgacccagaacataaggccggttcagagcgtagcttcaagtatgagacacaagagatttgcgggagtagtcctggcaggtgcggccctaggcgttgccacagctgctcagataacagccggcattgcacttcaccggtccatgctgaactctcaagccatcgacaatctgagagcgagcctggaaactactaatcaggcaattgaggcaatcagacaagcagggcaggagatgatcttggctgttcagggggtccaagactacatcaataatgagctgataccatctatgaaccagctatcttgtgatttaatcgggcagaagctcgggctcaaattgctcagatactatacagaaatcctgtcattatttggccccagcctacgagaccccatatctgcggagatatctatccaggccttgagctatgcacttggaggagatatcaataaggtgttagaaaagctcggatacagtggaggcgatttactgggcatcttagagagcagaggaataaaggctcggataactcacgtcgacacagagtcctacttcattgtcctcagtatagcctatccgacactgtccgagattaagggggtgattgtccatcggctagagggggtctcgtacaacataggctctcaagagtggtataccactgtgcccaagtatgttgcaacccaagggtaccttatctcgaattttgatgagtcatcgtgtaccttcatgccagaggggactgtgtgcagccaaaatgccttgtacccgatgagtcctctgctccaagaatgcctccgggggtccaccaagtcctgtgctcgtacactcgtatccgggtcttttgggaaccggttcattttatcacaagggaacctaatagccaattgtgcatcaattctttgcaagtgttacacaacaggaacgatcattaatcaagaccctgacaagattctaacatacatcgctgccgatcgctgcccggtagtcgaggtaaacggcgtgaccatccaagtcgggagcaggaggtatccagacgctgtgtatttgcacagaattgacctcggtcctcccatatcattggagaggttggacgtagggacaaatctggggaatgcaattgccaaattggaggatgccaaggaattgttggagtcatcggaccagatattgaggagtatgaaaggtttatcgagcactagcatagtctacatcctgattgcagtgtgtcttggagggctgatagggatccccactttaatatgttgctgcagggggcgttgtaacaaaaagggagaacaagttggtatgtcaagaccaggcctaaagcctgatcttacaggaacatcaaaatcatatgtaaggtcgctctga

SEQ ID NO: 41 - protein, 525 aa, Measles virus
MATLLRSLALFKRNKDKPPITSGSGGAIRGIKHIIIVPIPGDSSITTRSRLLDRLVRLIGNPDVSGPKLTGALIGILSLFVESPGQLIQRITDDPDVSIRLLEVVQSDQSQSGLTFASRGTNMEDEADQYFSHDDPSSSDQSRFGWFENKEISDIEVQDPEGFNMILGTILAQIWVLLAKAVTAPDTAADSELRRWIKYTQQRRVVGEFRLERKWLDVVRNRIAEDLSLRRFMVALILDIKRTPGNKPRIAEMICDIDTYIVEAGLASFILTIKFGIETMYPALGLHEFAGELSTLESLMNLYQQMGETAPYMVILENSIQNKFSAGSYPLLWSYAMGVGVELENSMGGLNFGRSYFDPAYFRLGQEMVRRSAGKVSSTLASELGITAEDARLVSEIAMHTTEDRISRAVGPRQSQVSFLHGDQNENELPRWGGKEDMRVKQSRGEARESYRETRPSRASDARATHPPTDTPLDIDTASESSQDPQDSRRSADALLRLQAMAGISEEQGSDTDTPRVYNDRDLLD

SEQ ID NO: 42 - DNA, 1685 bp, Measles virus
aggattcaagatcctattatcagggacaagagcaggattagggatatccgagatggccacacttctaaggagcttagcattgttcaaaagaaacaaggacaaaccacccattacatcaggatccggtggagccatcagaggaatcaaacacattattatagtaccaatcccgggagattcctcaattaccactcgatctagacttctggaccggttggtcaggttaattggaaacccggatgtgagcgggcccaaactaacaggggcactaataggtatattatccttatttgtggagtctccaggtcaattgattcagaggatcaccgatgaccctgacgttagcataaggctgttagaggttgtccagagtgaccagtcacaatctggccttaccttcgcatcaagaggtaccaacatggaggatgaggcggaccaatatttttcacatgatgatccaagtagtagtgatcaatccaggttcggatggttcgagaacaaggaaatctcagatattgaagtgcaagaccctgagggattcaacatgattctgggtaccatcctagctcaaatttgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctccttacgccgattcatggtcgctctaatcctggatatcaagagaacacccgggaacaaacccaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaatctttaccagcaaatgggggaaactgcaccatacatggtaatcctggagaactcaattcagaacaagttcagtgcaggatcataccctctgctctggagctatgccatgggagtaggagtggaacttgaaaactccatgggaggtttgaactttggccgatcttacttcgatccagcatattttagactagggcaagagatggtgaggaggtcagctggaaaggtcagttccacattggcatctgaactcggtatcactgccgaagatgcaaggcttgtttcagagatcgcaatgcatactacagaggacaggatcagtagagcggttggacccagacaatcccaagtgtcattcctacacggtgatcaaaatgaaaatgagctaccgagatgggggggtaaggaagatatgagggtcaaacagagtcggggagaagccagagagagctacagagaaaccaggcccagcagagcaagtgacgcgagagctacccatcctccaaccgacacacccttagacattgacactgcatcggagtccagccaagatccgcaggacagtcgaaggtcagctgacgccctgctcaggctgcaagccatggcaggaatctcggaagaacaaggctcagacacggacacccctagagtgtacaatgacagagatcttctagactaggtgcaagaggccgaggaccagaacaacatccgcctaccctccatcattgttataa

SEQ ID NO: 43 - protein, 525 aa, Measles virus
MATLLRSLALFKRNKDKPPITSGSGGAIRGIKHIIIVPIPGDSSITTRSRLLDRLVRLIGNPDVSGPKLTGALIGILSLFVESPGQLIQRITDDPDVSIRLLEVVQSDQSQSGLTFASRGTNMEDEADQYFLHDDSSSGDQFRSGWFENKEISDIEVQDPEGFNMILGTILAQIWVLLAKAVTAPDTAADSELRRWIKYTQQRRVVGEFRLERKWLDVVRNRIAEDLSLRRFMVALILDIKRTPGNKPRIAEMICDIDTYIVEAGLASFILTIKFGIETMYPALGLHEFAGELSTLESLMNLYQQMGETAPYMVILENSIQNKFSAGSYPLLWSYAMGVGVELENSMGGLNFGRSYFDPAYFRLGQEMVRRSAGKVSSTLASELGITAEDARLVSEIAMHTTEDRISRAVGPRQAQVSFLHGDQSENELPGLGGKEDKRVKQSRGEARESYRETGHSRANDARAADLPTGTPLDIDTASEFSQDPQDSRRSADALLRLQAMAGIPEEQGSDMDTPRVYNDRDLLD

SEQ ID NO: 44 - DNA, 1578 bp, Measles virus
atggccacgctattaaggagcttagcattgttcaaaagaaacaaggacaaaccacccattacatcaggatccggtggggccatcagagggatcaaacacattattatagtaccaatccctggagactcctcaattaccactcgatccagacttctggaccggttggtcaggctaattggaaacccggatgtgagtgggcctaaattaacaggggcactaataggtatattgtccttatttgtggagtctccaggtcaattgattcagagaatcaccgatgaccctgacgttagcataaggctgttagaggttgtccagagcgaccagtcacaatctggccttacctttgcatcaagaggtaccaacatggaggatgaggcggaccaatactttttacatgatgattcaagtagcggtgatcaattcaggtccggatggttcgagaacaaggaaatctcagatattgaagtgcaggaccctgagggattcaacatgattctgggtaccatcctagctcaaatttgggtcttgctcgcaaaggcggttacggccccagacacggcagctgattcggagctaagaaggtggataaaatacacccaacaaagaagggtagtcggtgaattcagattggagagaaaatggttggatgtagtgaggaacaggattgccgaggacctctccttacgccggttcatggtcgctctaatcctggatatcaagagaacacccgggaacaaacccaggattgctgaaatgatatgtgacattgacacatatatcgtggaggcaggattagccagttttatccttactattaagtttgggatagaaaccatgtatcctgctcttggactgcatgaatttgctggtgagttatcaacacttgagtccttgatgaacctttatcagcaaatgggggaaactgcaccctacatggtcattctggagaactcaattcagaacaagttcagtgcaggatcataccctctgctctggagctatgccatgggagtaggagtggaactcgaaaactccatgggaggtttgaactttggccgatcttactttgatccagcatattttagattaggacaagagatggtcaggaggtcagctgggaaggtcagttccacattggcatctgaactcggtatcacggccgaggatgcaaggcttgtttcagagattgcaatgcatactactgaggacaggatcagtagagcggttggacccaggcaagcccaagtgtcatttctacacggtgatcaaagtgagaatgagctaccgggattgggaggtaaggaagataagagagtcaaacagagtcgaggagaagccagggagagctatagagaaactgggcacagcagagcaaatgatgcgagagctgctgaccttccaaccggcacacccctagacattgacactgcatcggagttcagccaagacccacaggacagtcgaaggtcagctgacgccctgctcaggctgcaagccatggcagggatcccggaagaacaaggctcagacatggacacccctagagtgtacaatgacagagatcttctagactag

SEQ ID NO: 45 - protein, 523 aa, Measles virus
MATLLRSLALFKRNKDKPPITSGSGGAIRGIKHIIIVPIPGDSSITTRSRLLDRLVRLIGNPDVSGPKLTGALIGILSLFVESPGQLIQRITDDPDVSIRLLEVVQSDQSQSGLTFASRGTNMEDEADQYFSHDDPISSDQSRFGWFENKEISDIEVQDPEGFNMILGTILAQIWVLLAKAVTAPDTAADSELRRWIKYTQQRRVVGEFRLERKWLDVVRNIIAEDLSLRRFMVALILDIKRTPGNKPRIAEMICDIDTYIVEAGLASFILTIKFGIETMYPALGLHEFAGELSTLESLMNLYQQMGKPAPYMVNLENSIQNKFSAGSYPLLWSYAMGVGVELENSMGGLNFGRSYFDPAYFRLGQEMVRRSAGKVSSTLASELGITAEDARLVSEIAMHTTEDKISRAVGPRQAQVSFLQGDQSENELPRLGGKEDRRVKQSRGEARESYRETGPSRASDARAAHLPTGTPLDIDTASESSQDPQDSRRSAEPLLSCKPWQESRKNKAQTRTPLQCTMTEIF

SEQ ID NO: 46 - DNA, 1631 bp, Measles virus
atggccacacttttaaggagcttagcattgttcaaaagaaacaaggacaaaccacccattacatcaggatccggtggagccatcagaggaatcaaacacattattatagtaccaatccctggagattcctcaattaccactcgatccagacttctggaccggttggtcaggttaattggaaacccggatgtgagcgggcccaaactaacaggggcactaataggtatattatccttatttgtggagtctccaggtcaattgattcagaggatcaccgatgaccctgacgttagcataaggctgttagaggttgtccagagtgaccagtcacaatctggccttaccttcgcatcaagaggtaccaacatggaggatgaggcggaccaatacttttcacatgatgatccaattagtagtgatcaatccaggttcggatggttcgagaacaaggaaatctcagatattgaagtgcaagaccctgagggattcaacatgattctgggtaccatcctagcccaaatttgggtcttgctcgcaaaggcggttacggccccagacacggcagctgattcggagctaagaaggtggataaagtacacccaacaaagaagggtagttggtgaatttagattggagagaaaatggttggatgtggtgaggaacattattgccgaggacctctccttacgccgattcatggtcgctctaatcctggatatcaagagaacacccggaaacaaacccaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaacctttaccagcaaatggggaaacctgcaccctacatggtaaacctggagaactcaattcagaacaagttcagtgcaggatcataccctctgctctggagctatgccatgggagtaggagtggaacttgaaaactccatgggaggtttgaactttggccgatcttactttgatccagcatattttagattagggcaagagatggtaaggaggtcagctggaaaggtcagttccacattagcatctgaactcggtatcactgccgaggatgcaaggcttgtttcagagattgcaatgcatactactgaggacaagatcagtagagcggttggacccagacaagcccaagtatcatttctacagggtgatcaaagtgagaatgagctaccgcgattggggggcaaggaagataggagggtcaaacagagtcgaggagaagccagggagagctacagagaaaccgggcccagcagagcaagtgatgcgagagctgcccatcttccaaccggcacacccctagacattgacactgcatcggagtccagccaagatccgcaggacagtcgaaggtcagctgagcccctgcttagctgcaagccatggcaggaatctcggaagaacaaggctcagacacggacacccctacagtgtacaatgacagaaatcttctagactaggtgcgagaggccgagggccagaacaacatccgcctaccctccatcattgttata

SEQ ID NO: 47 - protein, 300 aa, Measles virus
MHMFPLGVVEDSDPPGPPIGRASGSPPPGAGRSTAKPEELLKEATEANIVVRRTAGLNEKLAFHNNTPPTLPTPRRKAPTTGSVLNANQACNAVNLAPLDTPQRFRVVYMSITRPLDNGYYTVPRRMLEFRSVNAVAFNLLVTLRIDKAIGPGKIIDNAEQLPEATFMVHIGDFRRKKSEVYSADYCKMKIEKMGLVFALGGIGGTSLHTRSTGKMSKTLHAQLGFKKTSCYPPMDINEDLNRLLWRSRCKIVRIQAVLQPSVPQELRIYDDVIINDDQGVFKVLQTVVPSNARKRPPSQ

SEQ ID NO: 48 - DNA, 1454 bp, Measles virus
aggagcaaagtgattgcctcccaagctccacaacgacagagatccacgacctcgacaagtcggcatgggacatcaaggggtcgatcgctccgacacaacccaccacccacagtgatggcaggctggtgccccaggccagagccacagatcctggtctaggcgacaggaagggcgaacgccccatgcacatgtttccgctgggggtcgttgaggacagcgaccccccagggcctccaatcgggcgagcatccgggtccccgcccccaggcgctggcagatccacagcaaaacccgaagaactcctcaaagaggccaccgaggccaacatagtcgtcagacgcacagcagggctcaacgaaaaactggcgttccacaacaataccccaccaactctccccacaccccggagaaaggccccaacaacagggagcgtcctcaacgcaaaccaagcgtgcaatgcggtcaatctggcaccgctggacaccccgcagaggttccgtgttgtctacatgagcatcacccgtcccttggacaacgggtactacaccgttcccagaagaatgctggaattcaggtcggtcaatgcagtggccttcaacctgctggtgacccttagaattgacaaggcgattggccctgggaagatcatcgacaatgcagagcaacttcctgaggcaacattcatggtccacatcggggacttcaggagaaagaagagcgaagtctactctgccgactattgcaagatgaaaatcgaaaagatgggcctggtttttgcacttggtgggatagggggcaccagtcttcacactagaagcacaggcaaaatgagcaagactctccatgcacaactcgggttcaagaagacctcatgttacccaccaatggatatcaatgaagacctcaatcgactactctggaggagcagatgcaagatagtaagaatccaggcagttctgcagccatcagttccccaagaactccgcatttacgacgacgtgatcataaatgatgaccaaggagtattcaaagttctgcagaccgtggtgcccagcaatgcccgaaaacgacccccctcacaatgacagccaaaaggcccggacaaaaaaaccccccccgaaaaactccacggaccaagcgagaggccagccagcagctgacggcaagcgcgaacaccaggcggccccagcacagaacagccccgacacaaggccaccaccagccagcccaatctgcatcctcctcgtgggaccccggaggaccaacccccaaagttgcccccgacccaaaccaccaaccgcatccccaccacccctgggaaagaaacccccagcaactggaaggccccttcccccctccctcaacacaagaaccccacaaccgaaccgcacaagcgaccgaggtgacccaaccgcaggcacccgactccctagatagatcctctccccccgggc

SEQ ID NO: 49 - protein, 295 aa, Measles virus
MHMFPLGVVEDSDPPGPPIGRASGSPPPGAGRSTAKPEELLKEATEANIVVRRTAGLNEKLAFHNNTPPTLPTPRRKAPTTGSVLNANQACNAVNLAPLDTPQRFRVVYMSITRPLDNGYYTVPRRMLEFRSVNAVAFNLLVTLRIDKAIGPGKIIDNAEQLPEATFMVHIGDFRRKKSEVYSADYCKMKIEKMGLVFALGGIGGTSLHTRSTGKMSKTLHAQLGFKKTSCYPPMDINEDLNRLLWRSRCKIVRIQAVLQPSVPQELRIYDDVIINDDQGVFKVLQTVVPSNARK

SEQ ID NO: 50 - DNA, 1454 bp, Measles virus
aggagcaaagtgattgcctcccaagctccacaacgacagagatccacgacctcgacaagtcggcatgggacatcaaggggtcgatcgctccgacacaacccaccacccacagtgatggcaggctggtgccccaggccagagccacagatcctggtctaggcgacaggaagggcgaacgccccatgcacatgtttccgctgggggtcgttgaggacagcgaccccccagggcctccaatcgggcgagcatccgggtccccgcccccaggcgctggcagatccacagcaaaacccgaagaactcctcaaagaggccaccgaggccaacatagtcgtcagacgcacagcagggctcaacgaaaaactggcgttccacaacaataccccaccaactctccccacaccccggagaaaggccccaacaacagggagcgtcctcaacgcaaaccaagcgtgcaatgcggtcaatctggcaccgctggacaccccgcagaggttccgtgttgtctacatgagcatcacccgtcccttggacaacgggtactacaccgttcccagaagaatgctggaattcaggtcggtcaatgcagtggccttcaacctgctggtgacccttagaattgacaaggcgattggccctgggaagatcatcgacaatgcagagcaacttcctgaggcaacatttatggtccacatcggggacttcaggagaaagaagagtgaagtctactctgccgattattgcaagatgaaaatcgaaaagatgggcctggtttttgcacttggtgggatagggggcaccagtcttcacactagaagcacaggcaaaatgagcaagactctccatgcacaactcgggttcaagaagacctcatgttacccaccaatggatatcaatgaagacctcaatcgattactctggaggagcagatgcaagatagtaagaatccaggcagttctgcagccatcagttccccaagaactccgcatttacgacgacgtgatcataaatgatgaccaaggagtattcaaagttctgcagaccgtggtgcccagcaatgcccgaaaatgacccccctcacaatgacaaccaaaaggcccggacaaaaaaaccccccccgaaaaactccacggaccaagcgagaggccagccagcagctgacggcaagcgcgaacaccaggcggccccagcacagaacagccccgacacaaggccaccaccagccagcccaatctgcatcctcctcgtgggaccccggaggaccaacccccaaagttgcccccgacccaaaccaccaaccgcatccccaccacccccgggaaagaaacccccagcaactggaaggccccttcccccctccctcaacacaagaaccccacaaccgaaccgcacaagcgaccgaggtgacccaaccgcaggcacccgactccctagatagatcctctccccccgggc

SEQ ID NO: 51 - protein, 335 aa, Measles virus
MTEIYDFDKSAWDIKGSIAPIQPTTYSDGRLVPQVRVIDPGLGDRKDECFMYMFLLGVVEDSDSLGPPIGRAFGSLPLGVGRSTAKPEKLLKEATELDIVVRRTAGLNEKLVFYNNTPLTLLTPWRKVLTTGSVFNANQVCNAVNLIPLDTPQRFRVVYMSITRLSDNGYYTVPRRILEFRSVNAVAFNLLVTLRIDKAIGPGKIIDNTEQLPEATFMVHIGNFMRNKSEVYSADYCKMKIEKMGLVFALGGIGGTSLHIRSTGKMSKTLHAQLGFKKTLCYPLIDINEDLNRLLWRSRCKIVRIQAVLQPSVPQEFRIYDDVIINDDQGLFKVL

SEQ ID NO: 52 - DNA, 1008 bp, Measles virus
atgacagagatctacgacttcgacaagtcggcatgggacatcaaagggtcgatcgctccgatacaacccaccacctacagtgatggcaggctggtgccccaggtcagagtcatagatcctggtctaggcgacaggaaggatgaatgctttatgtacatgtttctgctgggggttgttgaggacagcgattccctagggcctccaatcgggcgagcatttgggtccctgcccttaggtgttggcagatccacagcaaagcccgaaaaactcctcaaagaggccactgagcttgacatagttgttagacgtacagcagggctcaatgaaaaactggtgttctacaacaacaccccactaactctcctcacaccttggagaaaggtcctaacaacagggagtgtcttcaacgcaaaccaagtgtgcaatgcggttaatctgataccgctcgataccccgcagaggttccgtgttgtttatatgagcatcacccgtctttcggataacgggtattacaccgttcctagaagaatactggaattcagatcggtcaatgcagtggccttcaacctgctggtgacccttaggattgacaaggcgataggccctgggaagatcatcgacaatacagagcaacttcctgaggcaacatttatggtccacatcgggaacttcatgagaaataagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccgctgatagatatcaatgaagaccttaatcgattactctggaggagcagatgcaagatagtaagaatccaggcagttttgcagccatcagttcctcaagaattccgcatttacgacgacgtgatcataaatgatgaccaaggactattcaaagttctgtag

SEQ ID NO: 53 - protein, 257 aa, Bovine respiratory syncytial virus
MSNHTHQLKFKTLKRAWKASKYFIVGLSCLYKFNLKSLVQTALTTLAMITLTSLVITAIIYISVGNAKAKPTFKPTIQQTQQPQNHTSPLFTEHNHKSTHTSIQSTTLSQPLNIDTTRGTTYSHSTDETQNRKNKSQSTLPANRQPPINPSGSNPPENHQDHNNSQTLPYVPCSTCKGNLACSSLCQIGLERAPSRAPTITLKRASKPKTTKKPTKTTTHHRTSPEAKLQPKNNTAAPQQGILSSPEHHTDQSTTQI

SEQ ID NO: 54 - DNA, 774 bp, Bovine respiratory syncytial virus
atgtccaaccatacccatcaacttaaattcaagacattaaagagggcttggaaagcctcaaaatacttcatagtaggattatcatgtttatataagttcaatttaaaatcccttgtccaaacggctttgaccaccttagctatgataaccttgacatcactcgtcataacagccattatttacattagtgtgggaaatgctaaagccaagcccacattcaaaccaaccatccaacaaacacaacagccccaaaaccatacctcacctcttttcacagagcacaaccacaaatcaactcacacatcaatccaaagcaccacactatcccaaccactaaacatagacaccactagaggaactacatacagtcactcaaccgatgaaacccaaaatagaaaaaacaaaagccaatccactctacctgccaacagacaaccaccaatcaacccatcgggaagcaacccccctgaaaaccaccaagaccacaacaactcccaaacactcccctatgtgccttgcagtacatgtaaaggcaatcttgcttgctcatcactctgccaaatcgggctggagagagcaccaagcagagcccccacaatcaccctaaaaagggcgtcaaaacccaaaaccaccaaaaaaccaaccaagacaacaacccaccacagaactagccctgaagccaaactgcaacccaaaaacaacacggcagctccacaacaaggcatcctctcttcaccagagcaccacacagatcaatcaactacacagatctaa

SEQ ID NO: 55 - protein, 295 aa, Human respiratory syncytial virus
MSKNKNQRTARTLEKTWDTLNHLIVISSCLYRLNLKSIAQIALSVLAMIISTSLIIAAIIFIISANHKVTPTTVTVQTIKNHTEKNITTYLTHVSPERVSPSKQPTTTLPIHTNSATISPNTKSETHHTTAQTKGIITTPTQTNKPSTKPRPKNPPKKPKDDYHFEVFNFVPCSICGNNQLCKSICKTIPSNKPKKKPTIKPTNKPTTKTTNKRDPKTLAKTLKKENTTNPTKKPTLKTTERDTSTPQSTVLDTTTSKHTIQQQSLHSTTPENTPNSTQIPTASEPSTSNSTQKI

SEQ ID NO: 56 - DNA, 921 bp, Human respiratory syncytial virus
ggggcaaatgcaaccatgtccaaaaacaagaatcaacgcactgccaggactctagaaaagacctgggatactcttaatcatctaattgtgatatcctcttgtttatacagattaaatttaaaatctatagcacaaatagcactatcagttttggcaatgataatctcaacctctctcataattgcagccataatattcatcatctctgccaatcacaaagttacaccaacaacggtcacagttcaaacaataaaaaaccacactgaaaaaaacatcaccacttaccttactcatgtctcaccagaaagggttagcccatccaaacaacccacaaccacactaccaatccacacaaactcagccacaatatcacctaatacaaaatcagaaacacaccatacaacagcacaaaccaaaggcataatcaccactccaacacagaccaacaagccaagcacaaaaccacgtccaaaaaatccaccaaaaaaaccaaaagatgattaccattttgaagtgttcaacttcgttccctgtagtatatgtggcaacaaccaactttgcaaatccatctgcaaaacaataccaagcaacaaaccaaagaaaaaaccaaccatcaaacccacaaacaaaccaaccaccaaaaccacaaacaaaagagacccaaaaacactagccaaaacgctgaaaaaagaaaacaccaccaacccaacaaaaaaaccaaccctcaagaccacagaaagagacaccagcactccacaatccaccgtgctcgacacaaccacatcaaaacacacaatccaacagcaatccctccactcaaccacccccgaaaacacacccaactccacacaaatacccacagcatccgagccctccacatcaaattccacccaaaaaatctagtcacatgcttagttattc

SEQ ID NO: 57 - protein, 315 aa, Human respiratory syncytial virus
MSKNKNQRTARTLEKTWDTLNHLIVISSCLYKLNLKSIAQIALSVLAMIISTSLIIAAIIFIISANHKVTLTTVTVQTIKNHTEKNITTYLTQVSPERVSPSKQPTTTPPIHTNSATISPNTKSETHHTTAQTKGRTTTPTQNNKPSTKPRPKNPPKKPKDDYHFEVFNFVPCSICGNNQLCKSICKTIPSNKPKKKPTIKPTNKPPTKTTNKRDPKTLAKTLKKETTINPTKKPTPKTTEGDTSTSQSTVLDTTTSKHTERDTSTSQSTVLDTTTSKHTIQQQSLYSTTPENTPNSTQTPTASEPSTSNSTQKL

SEQ ID NO: 58 - DNA, 981 bp, Human respiratory syncytial virus
ggggcaaatgcaaccatgtccaaaaacaagaatcaacgcactgccaggactctagaaaagacctgggatactcttaatcatctaattgtaatatcctcttgtttatacaaattaaatttaaaatctatagcacaaatagcactatcagttttggcaatgataatctcaacctctctcataattgcagccataatattcatcatctctgccaatcacaaagttacactaacaactgtcacagttcaaacaataaaaaaccacactgagaaaaacatcaccacttaccttactcaagtctcaccagaaagggttagcccatccaaacaacccacaaccacaccaccaatccacacaaactcagccacaatatcacctaatacaaaatcagaaacacaccatacaacagcacaaaccaaaggcagaaccaccactccaacacagaacaacaagccaagcacaaaaccacgtccaaaaaatccaccaaaaaaaccaaaagatgattaccattttgaagtattcaacttcgttccctgtagtatatgtggcaacaatcaactctgcaaatccatttgcaaaacaataccaagcaataaaccaaagaaaaaaccaaccataaaacccacaaacaaaccacccaccaaaaccacaaacaaaagagacccaaaaactctagccaaaacactgaaaaaagaaactaccatcaacccaacaaaaaaaccaacccccaagaccacagaaggagacaccagcacctcacagtccactgtgctcgacacaaccacatcaaagcacacagaaagagacaccagcacctcacaatccactgtgctcgacacaaccacatcaaaacacacaatccaacagcaatccctctactcaaccacccctgaaaacacacccaactccacacaaacacccacagcatccgagccctccacatcaaattccacccaaaaactctagtcatatgcttagttattc

SEQ ID NO: 59 - protein, 574 aa, Human respiratory syncytial virus
MELPILKTNAITTILAAVTLCFASSQNITEEFYQSTCSAVSKGYLSALRTGWYTSVITIELSNIKENKCNGTDAKAKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLHLKNYIDKQFLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVMDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSS

SEQ ID NO: 60 - DNA, 1899 bp, Human respiratory syncytial virus
cgcgcaaataacaatggagttgccaatcctcaaaacaaatgctattaccacaatccttgctgcagtcacactctgtttcgcttccagtcaaaacatcactgaagaattttatcaatcaacatgcagtgcagttagcaaaggctatcttagtgctctaagaactggttggtatactagtgttataactatagaattaagtaatattaaagaaaataagtgtaatggaacagacgccaaggcaaaattgataaaacaagaattagataaatataaaaatgctgtaacagaattgcagttgctcatgcaaagtactccagcagccaacaatcgagccagaagagaactaccaaggtttatgaattatacactcaacaataccaaaaacaccaatgtaacattaagcaagaaaaggaaaagaagatttcttggttttttgttaggtgttggatctgcaatcgccagtggcattgccgtatccaaggtcctacacctagaaggggaagtgaacaaaatcaaaagtgctctactatccacaaacaaggctgtagtcagcttatcaaatggagtcagtgttttaaccagcaaagtgttacatctcaaaaactatatagataaacagttcttacctattgtgaacaagcaaagctgcagcatatcaaacattgcgactgtgatagagttccaacaaaagaacaacagactactagagattaccagggaatttagtgttaatgcaggcgtaactacacctgtaagtacttatatgttaactaatagtgaattattatcattaatcaatgatatgcctataacaaatgatcagaaaaagttaatgtccaacaatgtccaaatagttagacagcaaagttactctatcatgtccataataaaggaggaagtcttagcatatgtagtacaattaccactatatggtgtaatggatacaccttgttggaaactgcacacatcccctctatgtacaaccaacacaaaggaagggtccaacatctgcttaacaagaaccgacagaggatggtactgtgacaatgcaggatcagtatctttcttcccacaagctgaaacatgtaaagttcaatcgaatcgggtattttgtgacacaatgaacagtttaacattaccaagtgaggtaaatctctgcaacattgacatattcaaccccaaatatgattgtaaaattatgacttcaaaaacagatgtaagcagctccgttatcacatctctaggagccattgtgtcatgctatggcaaaactaaatgtacagcatccaataaaaatcgtgggatcataaagacattttctaacgggtgtgattatgtatcaaataagggggtggatactgtgtctgtaggtaatacattatattatgtaaataagcaagaaggcaaaagtctctatgtaaaaggtgaaccaataataaatttctatgacccattagtgttcccctctgatgaatttgatgcatcaatatctcaagtcaatgagaagattaaccagagtctagcatttattcgtaaatcagatgaattattacataatgtaaatgctggtaaatccaccattaatatcatgataactactataattatagtgattatagtaatattgttatcattaattgcagttggactgcttctatactgcaaggccagaagcacaccagtcacactaagtaaggatcaactgagtggtataaataatattgcatttagtagctgaataaaaatagcacttaatcatattcttacaatggttcactatctgaccatagataacccatctatcattggattttcttaaaatttgaacttcatcacaactttcatctataaaccatctcacttacactatttaagtagattcctagtttatagttatat

SEQ ID NO: 61 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLMKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 62 - DNA, 1864 bp, Human respiratory syncytial virus
taacaatggagttgccaatcctcaaagcaaatgcaattaccacaatcctcgctgcagtcacattttgctttgcttctagtcaaaacatcactgaagaattttatcaatcaacatgcagtgcagttagcaaaggctatcttagtgctctaagaactggttggtatactagtgttataactatagaattaagtaatatcaaggaaaataagtgtaatggaacagatgctaaggtaaaattgatgaaacaagaattagataaatataaaaatgctgtaacagaattgcagttgctcatgcaaagcacaccagcagcaaacaatcgagccagaagagaactaccaaggtttatgaattatacactcaacaataccaaaaaaaccaatgtaacattaagcaagaaaaggaaaagaagatttcttggttttttgttaggtgttggatctgcaatcgccagtggcattgctgtatctaaggtcctgcacttagaaggagaagtgaacaagatcaaaagtgctctactatccacaaacaaggccgtagtcagcttatcaaatggagttagtgtcttaaccagcaaagtgttagacctcaaaaactatatagataaacaattgttacctattgtgaataagcaaagctgcagaatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgtgatagatacaccttgttggaaattacacacatcccctctatgtacaaccaacacaaaagaagggtcaaacatctgtttaacaagaactgacagaggatggtactgtgacaatgcaggatcagtatctttcttcccacaagctgaaacatgtaaagttcaatcgaatcgagtattttgtgacacaatgaacagtttaacattaccaagtgaagtaaatctctgcaatgttgacatattcaatcccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgtgattatgtatcaaataaaggggtggacactgtgtctgtaggtaacacattatattatgtaaataagcaagaaggcaaaagtctctatgtaaaaggtgaaccaataataaatttctatgacccattagtattcccctctgatgaatttgatgcatcaatatctcaagtcaatgagaagattaaccagagtttagcatttattcgtaaatccgatgaattattacataatgtaaatgctggtaaatcaaccacaaatatcatgataactactataattatagtgattatagtaatattgttatcattaattgctgttggactgctcctatactgtaaggccagaagcacaccagtcacactaagcaaggatcaactgagtggtataaataatattgcatttagtaactgaataaaaatagcacctaatcatgttcttacaatggtttactatctgctcatagacaacccatctatcattggattttcttaaaatctgaacttcatcgaaactcttatctataaaccatctcacttacactattt

SEQ ID NO: 63 - protein, 538 aa, Turkey rhinotracheitis virus
MDVRICLLLFLISNPSSCIQETYNEESCSTVTRGYKSVLRTGWYTNVFNLEIGNVENITCNDGPSLIDTELVLTKNALRELKTVSADQVAKESRLSSPRRRRFVLGAIALGVATAAAVTAGVALAKTIRLEGEVKAIKNALRNTNEAVSTLGNGVRVLATAVNDLKEFISKKLTPAINQNKCNIADIKMAISFGQNNRRFLNVVRQFSDSAGITSAVSLDLMTDDELVRAINRMPTSSGQISLMLNNRAMVRRKGFGILIGVYDGTVVYMVQLPIFGVIETPCWRVVAAPLCRKEKGNYACILREDQGWYCTNAGSTAYYPNKDDCEVRDDYVFCDTAAGINVALEVEQCNYNISTSKYPCKVSTGRHPVSMVALTPLGGLVSCYESVSCSIGSNKVGIIKQLGKGCTHIPNNEADTITIDNTVYQLSKVVGEQRTIKGAPVVNNFNPILFPEDQFNVALDQVFESIDRSQDLIDKSNDLLGADAKSKAGIAIAIVVLVILGIFFLLAVIYYCSRVRKTKPKHDYPATTGHSSMAYVS

SEQ ID NO: 64 - DNA, 1636 bp, Turkey rhinotracheitis virus
gggacaagtaggatggatgtaagaatctgtctcctattgttccttatatctaatcctagtagctgcatacaagaaacatacaatgaagaatcctgcagtactgtaactagaggttataagagtgtgttaaggacagggtggtatacgaatgtatttaacctcgaaatagggaatgttgagaacatcacttgcaatgatggacccagcctaattgacactgagttagtactcacaaagaatgctttgagggagctcaaaacagtgtcagctgatcaagtggctaaggaaagcagactatcctcacccaggagacgtagatttgtactgggtgcaatagcacttggtgttgcgacagctgctgccgtaacagctggtgtagcacttgcaaagacaattagattagagggagaggtgaaggcaattaagaatgccctccggaacacaaatgaggcagtatccacattagggaatggtgtgagggtactagcaactgcagtcaatgacctcaaagaatttataagtaaaaaattgactcctgctattaaccagaacaaatgcaatatagcagatataaagatggcaattagttttggccaaaataacagaaggttcctgaatgtggtgaggcaattctctgatagtgcaggtatcacatcagctgtgtctcttgatttaatgacagatgatgaacttgttagagcaattaacagaatgccaacttcatcaggacagattagtttgatgttgaacaatcgtgccatggttagaaggaaggggtttggtatattgattggtgtttatgatggaacggtcgtttatatggtacaactgcccatattcggcgtgattgagacaccttgttggagggtggtggcagcaccactctgtaggaaagagaaaggcaattatgcttgtatactgagagaagatcaagggtggtactgtacaaatgctggctctacagcttattatcctaataaagatgattgtgaggtaagggatgattatgtattttgtgacacagcagctggcattaatgtggccctagaagttgaacagtgcaactataacatatcgacttctaaatacccatgcaaagtcagcacaggtagacaccctgtcagtatggtagccttaacccccctagggggtctagtgtcttgttatgagagtgtaagttgctccataggtagcaataaagtagggataataaaacagctaggcaaagggtgcacccacattcccaacaacgaagctgacacgataaccattgataacactgtgtaccaattgagcaaggttgtaggcgaacagaggaccataaaaggagctccagttgtgaacaattttaacccaatattattccctgaggatcagttcaatgttgcacttgaccaagtatttgagagtatagatagatctcaggacttaatagataagtctaacgacttgctaggtgcagatgccaagagcaaggctggaattgctatagcaatagtagtgctagtcattctaggaatcttctttttacttgcagtgatatattactgttccagagtccggaagaccaaaccaaagcatgattacccggccacgacaggtcatagcagcatggcttatgtcagttaagttattt

SEQ ID NO: 65 - protein, 256 aa, Ovine respiratory syncytial virus
METYVNKLHEGSTYTAAVQYNVLEKDDDPASLTIWVPMFQSSISADLLIKELINVNILVRQISTLKGPSLKIMINSRSAVLAQMPNKFTISANVSLDERSKLAYDITTPCEIKACSLTCLKVKNMLTTVKDLTMKTFNPTHEIIALCEFENIMTSKKVVIPTFLRSINVKAKDLDSLENIATTEFKNAITNAKIIPYAGLVLVITVTDNKGAFKYIKPQSQFIVDLGAYLEKESIYYVTTNWKHTATRFSIKPIED

SEQ ID NO: 66 - DNA, 948 bp, Ovine respiratory syncytial virus
ggggcaaatatggagacatacgtgaacaaactccatgaagggtcaacatacacagctgctgtccaatacaatgttctagaaaaggatgatgatcctgcatctctcacgatatgggttcctatgtttcaatcatccatttctgctgacttactcataaaggagttaatcaatgtgaacatattagtacgacaaatttctactctgaaaggcccatcattaaaaattatgataaactctagaagtgctgtactagctcaaatgcccaacaagtttactataagtgcaaatgtgtcattggatgaacggagcaagttggcatatgacataaccaccccttgtgagatcaaagcttgcagtttgacatgcttaaaagtaaaaaatatgctcactactgtaaaagatcttactatgaaaacattcaatcccactcatgaaatcattgcactgtgtgaatttgaaaatattatgacgtctaagaaagttgtaataccaacttttttaaggtctattaatgtgaaggcaaaggatttagattcactggaaaacatagctacaacagagtttaaaaatgccatcactaatgctaaaattataccttacgctgggttagtgttagtcattaccgtaactgacaacaaaggagcatttaagtatatcaagccacaaagccaatttatagttgatcttggtgcatatcttgaaaaagagagcatatattatgtaactacaaattggaaacacacagccactagattctccatcaaacctatagaagattaaatcctaaacaaattatcttgccaaaatagaacactctattaagaacctacaaaacaccattgaaatcaaatcctattgatactccattgaacatcactgtcacacattcccaatctggtcaattcacttgatcatctattctgttaattatacctctattagataaat

SEQ ID NO: 67 - protein, 186 aa, Ovine respiratory syncytial virus
MSRRNPCKYEIRGHCLNGKKCHFSHNYFEWPPHALLVRQNFMLNKILKSMDRSNDTLSEISGAAELDRTEEYALGVIGVLESYLGSVNNITKQSACVAMSKLLGEINSDDIKGLRNKELPTSPKIRIYNTVISYIDSNKRNPKQTIHLLKRLPADVLKKTIKNTIDIHNEINVNNPSDIGVNEQNE

SEQ ID NO: 68 - DNA, 964 bp, Ovine respiratory syncytial virus
ggggcaaatatgtcacgaagaaatccctgcaaatatgagatcaggggacattgcttaaatggcaaaaaatgccatttcagccataattactttgaatggcctccacatgctttattagtgaggcaaaattttatgttaaacaagatattaaagtctatggataggagcaatgatactctgtcagagataagtggagctgcagaattagatagaacagaggaatatgcattaggtgtgataggagttttagaaagttacttgggctctgttaataacataacaaaacaatcagcttgtgttgctatgagtaaattattaggtgagattaatagtgatgacatcaaaggattaagaaacaaagaattgccaacttcacctaagataagaatatataacacagttatatcatatattgatagcaacaagagaaacccaaaacaaactatacatttacttaaaagattgcctgcagatgtgcttaagaagaccatcaagaatacaatagatattcacaatgaaataaatgttaataatccaagtgacataggtgttaatgaacaaaatgaataattccaatatcattattttcccagagaaatatccttgtagtatatcttctttgttaatcagagatgagaataatgttattgtattaaatcatcagaatatttttgactgctcacagtctcaacatccatgtgatatgtatcctcaaaatcatatacttgactatacctattggacatcacaggaattgattgacgatgtactaaagattcttcacctttctagcatccccataaataggtatgtggtctatgtcttagtgctgtagtatgtaaatcatttaactttcaatcattatctatatatttctccttgtagccggaaatacaccagaggacaaaatggactcactcattcatgaaaactcaaccaatgtatacttaacagatagttattt

SEQ ID NO: 69 - protein, 391 aa, Ovine respiratory syncytial virus
MALSKVKLNDTFNKDQLLSTSKYTIQRSTGDNIDIPNYDVQKHLNKLCGMLLITEDANHKFTGLIGMLYAMSRLGREDTLKILKDAGYQVKANGVDVITHRQDVNGKEMKFEVLTLVSLTSEVQVNIEVESRKSYKKMLKEMGEVAPEYRHDSPDCGMIVLCIAALVIAKLAAGDRSGLTAVIRRANNVLKNEIERYKGLIPKDVANSFYEVFEKYPHYIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKNQLNPKDNDVEL

SEQ ID NO: 70 - DNA, 1197 bp, Ovine respiratory syncytial virus
ggggcaaatacaaaaatggctctcagcaaggttaaactgaatgacaccttcaacaaagatcaattgctatcaactagcaaatataccatccaacgtagcactggagataatattgacatacctaattatgatgtacaaaagcatctcaataaattgtgtggtatgctgctaataacagaagatgctaatcacaaatttacaggattaataggtatgttatatgccatgtctcgattgggaagggaagataccctcaaaatactcaaggatgcaggttaccaagtaaaggccaatggagttgatgtaattacacatcgacaagatgtaaatggaaaagaaatgaaatttgaagtgctaacactagtcagcttaacatcagaagttcaagttaacattgaggtagaatcaaggaaatcttacaaaaagatgctaaaagagatgggagaggtagctccagaatacagacatgattctcctgattgtggtatgatagtgctatgtattgctgctttggttatagcaaaattagcagcaggggatagatcaggcctcaccgcagtcatcagaagagccaacaatgtgcttaagaatgaaatagagcgatacaagggacttataccaaaggatgtagccaacagcttctatgaagtatttgaaaagtatcctcattatatagacgtatttgtacattttggaattgctcagtcctcaacaagaggaggtagtagggtagaggggatctttgcagggttattcatgaatgcgtatggagcaggtcaagtaatgttaagatggggtgtattagccaaatcagtcaagaatatcatgcttggtcatgccagtgtgcaagctgaaatggaacaagttgtagaagtctatgaatatgcacaaaaattaggaggagaagcaggtttctaccacatattaaacaacccaaaagcatcattattgtcccttacacagtttcctaacttctccagtgtagtcctaggtaatgctgctggtttgggaataatgggtgagtatagaggtacacctaggaatcaggatttatatgatgctgccaaagcatatgcagaacaactgaaagagaatggagtcatcaattacagtgtattagatctaactacagaggaattagaggcaatcaagaaccagctaaatcccaaggataatgatgtggaactgtgagttaat

SEQ ID NO: 71 - protein, 467 aa, Human respiratory syncytial virus
MALSKVKLNDTLNKDQLLSSSKYTIQRSTGDSIDTPNYDVQKHINKLCGMLLITEDANHKFTGLIGMLYAMSRLGREDTIKILRDAGYHVKANGVDVTTHRQDINGKEMKFEVLTLASLTTEIQINIEIESRKSYKKMLKEMGEVAPEYRHDSPDCGMIILCIAALVITKLAAGDRSGLTAVIRRANNVLKNEMKRYKGLLPKDIANSFYEVFEKHPHFIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPHFSSVVLGNAAGLGIMGEYRGTPRNQDLYDAAKAYAEQLKENGVINYSVLDLTAEELTLKTTKKDPKPQTTKSKEVPTTKPTEEPTINTTKTNIITTLLTSNTTGNPELTSQMETFHSTSSEGNPSPSQVSTTSEYPSQPSSPPNTPRQ

SEQ ID NO: 72 - DNA, 1421 bp, Human respiratory syncytial virus
caaatacaaagatggctcttagcaaagtcaagttgaatgatacactcaacaaagatcaacttctgtcatccagcaaatacaccatccaacggagcacaggagatagtattgatactcctaattatgatgtgcagaaacacatcaataagttatgtggcatgttattaatcacagaagatgctaatcataaattcactgggttaataggtatgttatatgcgatgtctaggttaggaagagaagacaccataaaaatactcagagatgcgggatatcatgtaaaagcaaatggagtagatgtaacaacacatcgtcaagacattaatggaaaagaaatgaaatttgaagtgttaacattggcaagcttaacaactgaaattcaaatcaacattgagatagaatctagaaaatcctacaaaaaaatgctaaaagaaatgggagaggtagctccagaatacaggcatgactctcctgattgtgggatgataatattatgtatagcagcattagtaataactaaattagcagcaggggacagatctggtcttacagccgtgattaggagagctaataatgtcctaaaaaatgaaatgaaacgttacaaaggcttactacccaaggacatagccaacagcttctatgaagtgtttgaaaaacatccccactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgttaggacatgctagtgtgcaagcagaaatggaacaagttgttgaggtttatgaatatgcccaaaaattgggtggtgaagcaggattctaccatatattgaacaacccaaaagcatcattattatctttgactcaatttcctcacttctccagtgtagtattaggcaatgctgctggcctaggcataatgggagagtacagaggtacaccgaggaatcaagatctatatgatgcagcaaaggcatatgctgaacaactcaaagaaaatggtgtgattaactacagtgtactagacttgacagcagaagaactaaccctcaagacaaccaaaaaagatcccaaacctcaaaccactaaatcaaaggaagtacccaccaccaagcccacagaagagccaaccatcaacaccaccaaaacaaacatcataactacactactcacctccaacaccacaggaaatccagaactcacaagtcaaatggaaaccttccactcaacttcctccgaaggcaatccaagcccttctcaagtctctacaacatccgagtacccatcacaaccttcatctccacccaacacaccacgccagtagttactt

SEQ ID NO: 73 - protein, 391 aa, Bovine respiratory syncytial virus
MALSKVKLNDTFNKDQLLSTSKYTIQRSTGDNIDIPNYDVQKHLNKLCGMLLITEDANHKFTGLIGMLYAMSRLGREDTLKILKDAGYQVRANGVDVITHRQDVNGKEMKFEVLTLVSLTSEVQGNIEIESRKSYKKMLKEMGEVAPEYRHDFPDCGMIVLCVAALVITKLAAGDRSGLTAVIRRANNVLRNEMKRYKGLIPKDIANSFYEVFEKYPHYIDVFVHFGIAQSSTRGGSRVEGIFAGLFMNAYGAGQVMLRWGVLAKSVKNIMLGHASVQAEMEQVVEVYEYAQKLGGEAGFYHILNNPKASLLSLTQFPNFSSVVLGNAAGLGIMGEYRGTPRNQDLYDAAKAYAEQLKENGVINYSVLDLTTEELEAIKNQLNPKDNDVEL

SEQ ID NO: 74 - DNA, 1197 bp, Bovine respiratory syncytial virus
  misc_feature (1)..(1): n is a, c, g, or t
ngggcaaatacaaaaatggctcttagcaaggtcaaactaaatgacactttcaacaaggaccaactgttgtcaaccagcaaatatactattcaacgtagtacaggtgacaacattgatatacccaattacgatgtgcaaaaacatctcaataagttgtgtggtatgctattaataacagaagatgccaatcataaatttacaggactgataggtatgttatatgctatgtcccgattggggagagaagatacccttaaaatactcaaagatgcaggctaccaagtgagggccaatggggttgatgtgataacacatcgacaggatgtgaatggaaaagaaatgaaatttgaagtgctaacattagtcagcttaacatcagaagttcaaggtaatatagaaatagagtcaaggaagtcttacaaaaagatgctaaaagagatgggagaggtagctccagaatacagacatgactttcctgattgtggtatgatagtgctatgtgttgctgctttggttataacaaaattagcagcaggtgataggtcaggcctcactgcagtcattaggagagccaacaatgtactaaggaatgaaatgaaacgatacaaaggactcatcccgaaagatatagccaacagcttctatgaagtatttgaaaagtaccctcattacatagatgtattcgtacattttggcattgctcaatcctcaactagaggaggtagtagggtagaaggaatctttgcagggttattcatgaatgcatatggagcaggtcaagtgatgttaagatggggtgtgctagccaaatcagtcaagaacattatgcttggtcatgccagcgtacaagcagaaatggaacaggttgtagaagtctatgaatatgcacaaaagttaggtggagaagctggtttttatcacatactgaacaatcctaaagcatcattgttatccttgacacaattccccaacttctctagtgtagtcctaggcaatgctgcaggactaggtataatgggtgagtatagaggtacaccaagaaaccaagacttgtatgatgctgccaaagcatatgcagaacaactaaaagagaatggggtcatcaattacagtgtgttggatctgactacagaggaattagaggcaatcaagaaccaattgaatcccaaagataatgatgtggaattgtgagttaat

SEQ ID NO: 75 - protein, 515 aa, Human parainfluenza virus 3
MLSLFDTFNARRQENITKSAGGAIIPGQKNTVSIFALGPTITDDNEKMTLALLFLSHSLDNEKQHAQRAGFLVSLLSMAYANPELYLTTNGSNADVKYVIYMIEKDLKRQKYGGFVVKTREMIYEKTTEWIFGSDLDYDQETMLQNGRNNSTIEDLVHTFGYPSCLGALIIQIWIVLVKAITSISGLRKGFFTRLEAFRQDGTVQAGLVLSGDTVDQIGSIMRSQQSLVTLMVETLITMNTSRNDLTTIEKNIQIVGNYIRDAGLASFFNTIRYGIETRMAALTLSTLRPDINRLKALMELYLSKGPRAPFICILRDPIHGEFAPGNYPAIWSYAMGVAVVQNRAMQQYVTGRSYLDIDMFQLGQAVARDAEAQMSSTLEDELGVTHEAKESLKRHIRNINSSETSFHKPTGGSAIEMAIDEEPEQFEHRADQEQDGEPQSSIIQYAWAEGNRSDDRTEQATESDNIKTEQQNIRDRLNKRLNDKKKQGSQPSTNPTNRTNQDEIDDLFNAFGSN

SEQ ID NO: 76 - DNA, 1642 bp, Human parainfluenza virus 3
gaggattaaagacattgactagaaggtcaagaaaagggaactctataatttcaaaaatgttgagcctatttgatacatttaatgcacgtaggcaagaaaacataacaaaatcagctggtggagctatcattcctggacagaaaaatactgtctccatatttgcccttggaccgacaataactgatgacaatgagaaaatgacattagctcttctatttctatctcattcactagataatgagaaacaacatgcacaaagggcagggttcttggtgtctttattgtcaatggcttatgccaatccagagctttacctgacaacaaatggaagtaatgcagatgttaaatatgtcatatatatgattgagaaagatctaaaacggcaaaagtatggaggatttgtggttaagacgagagagatgatatatgaaaagacaactgagtggatatttggaagtgacctggattatgaccaggaaactatgctgcagaacggcagaaacaattcaacgattgaagatcttgttcacacatttgggtatccatcatgtttaggagctcttataatacagatctggatagttttggtcaaagccatcactagcatctcagggttaagaaaaggctttttcactcgattagaggctttcagacaagatggaacagtgcaagcagggctggtattgagcggtgacacagtggatcagattgggtcaatcatgcggtctcaacagagcttggtaactcttatggttgagacattaataacaatgaatactagcagaaatgacctcacaaccatagaaaagaatatacaaattgttggtaactacataagagatgcaggtcttgcttcattcttcaatacaatcaggtatggaattgagactagaatggcagctttgactctatctactctcagaccagatatcaatagattaaaagctctgatggaattgtatttatcaaagggaccacgcgctccttttatctgtatcctcagagatcctatacatggtgagttcgcaccaggcaactatcctgccatatggagttatgcaatgggggtggcagttgtacaaaacagagccatgcaacagtatgtgacgggaagatcatatctagatattgatatgttccagctgggacaagcagtagcacgtgatgctgaagctcagatgagctcaacactggaagatgaacttggagtgacacacgaagccaaagaaagcttgaaaagacatataaggaacataaacagttcagagacatctttccacaaaccaacaggcggatcagccatagagatggcaatagatgaagagccagaacaatttgaacacagagcagatcaagaacaagatggagaacctcaatcatctataatccaatatgcttgggcagaaggaaacagaagtgatgatcggaccgagcaagctacagaatccgacaatatcaagactgaacaacaaaacatcagagacagactaaacaagagactcaacgacaagaagaaacaaggcagtcaaccatccaccaatcccacaaacagaacgaaccaggacgaaatagacgatctgttcaatgcatttggaagcaactaactgagtcaacattttgatctaaatcaataataaataag

SEQ ID NO: 77 - protein, 539 aa, Human parainfluenza virus 3
MPTSILLIITTMIMASFCQIDITKLQHVGVLVNSSKGMKISQNFETRYLILSLIPKIEDSNSCGDQQIKQYKRLLDRLIIPLYDGLRLQKDVIVSNQESNENTDPRTKRFFGGVIGTIALGVATSAQITAAVALVEAKQARSDIEKLKEAIRDTNKAVQSVQSSIGNLIVAIKSVQDYVNKEIVPSIARLGCEAAGLQLGIALTQHYSELTNIFGDNIGSLQEKGIKLQGIASLYRTNITEIFTTSTVDKYDIYDLLFTESIKVRVIDVDLNDYSIALQVRLPLLTRLLNTQIYRVDSISYNIQNREWYIPLPSHIMTKGAFLGGADVKECIEAFSSYICPSDPGFVLNHEMESCLSGNISQCPRTVVKSDIVPRYAFVNGGVVANCITTTCTCNGIGNRINQPPDQGVKIITHKECNTIGINGMLFNTNKEGTLAFYTPNDITLNNSVALDPIDISIELNKAKSDLEESKEWIRRSNQKLDSIGNWHQSSTTIIIVLIMIIILFIINVTIIIIAVKYYRIQKRNRVDQNDKPYVLTNK

SEQ ID NO: 78 - DNA, 1845 bp, Human parainfluenza virus 3
aggacaaaagaagtcaataccaacaactattagcagccacactcgctggaacaagaaagaagggataaaaaaagtttaacagaagaaacaaaaacaaaaagcacagaacaccagaacaacaagatcaaaacacccaacccactcaaaacgaaaatctcaaaagagattggcaacacaacaaacactgaacatcatgccaacctcaatactgctaattattacaaccatgattatggcatctttctgccaaatagatatcacaaaactacagcatgtaggtgtattggttaacagttccaaagggatgaagatatcacaaaactttgaaacaagatatctaattttgagcctcataccaaaaatagaagattctaactcttgtggtgaccaacagatcaagcaatacaagaggttattggatagactgatcattcctttatatgatggattaagattacagaaggatgtgatagtgtccaatcaagaatccaatgaaaacactgaccccagaacaaaacgattctttggaggggtaattggaactattgctctgggagtggcaacctcagcacaaattacagcggcagttgctctggttgaagccaagcaggcaagatcagacattgaaaaactcaaggaagcaatcagggacacaaacaaagcagtgcagtcagtccagagctccataggaaatttgatagtagcaattaaatcggtccaggattatgtcaacaaagaaatcgtgccatcaattgcgagattaggttgtgaagcagcaggacttcagttaggaattgcattaacacagcattactcagaattaacaaacatattcggtgataacataggatcgttacaagaaaaagggataaaattacaaggtatagcatcattataccgcacaaatatcacagagatattcacaacatcaacagttgataaatatgatatttatgatctattatttacagaatcaataaaggtgagagttatagatgttgacttgaatgattactcgatcgccctccaagtcagactccctttattaactagactgctgaacacccagatttacagagtagattccatatcatataacatccaaaacagagaatggtatatccctcttcccagccacatcatgacaaaaggggcatttctaggtggagcagatgtcaaagaatgtatagaagcattcagcagttatatatgcccttctgatccaggatttgtactaaaccatgaaatggagagctgtttatcaggaaacatatcccaatgtccaagaaccgtggttaaatcagacattgttccaagatatgcatttgtcaatggaggagtggttgcaaattgtataacaaccacatgtacatgcaacggtatcggtaatagaatcaatcaaccacctgatcaaggagtaaaaattataacacataaagaatgtaatacaataggtatcaacggaatgctgttcaatacaaataaagaaggaactcttgcattttacacaccaaatgatataacattaaacaattctgttgcacttgatccaattgacatatcaatcgagctcaataaggccaaatcagatctagaagagtcaaaagaatggataagaaggtcaaatcaaaaactagattccattggaaattggcatcaatctagcaccacaatcataattgttttgataatgataattatattgtttataattaatgtaacgataattataattgcagttaagtattacagaattcaaaagagaaatcgagtggatcaaaatgataaaccatatgtattaacaaacaaatgacagatctatagatcattagatattaaaattat

SEQ ID NO: 79 - protein, 539 aa, Guinea pig parainfluenza virus TS-9
MPISILLIITTMIMASFCQIDITKLHHVGVLVNSPKGMKISQNFETRYLILSLIPKIEDSNSCGDQQIRQYKKLLDRLIIPLYDGLRLQKDVIVTNQESNENTDPRTKRFFGGVIGTIALGVATSAQITAAVALVEAKQARSDIEKLKEAIRDTNKAVQSVQSSIGNLIVAIKSVQDYVNKEIVPSIARLGCEAAGLQLGIALTQHYSELTNIFGDNIGSLQEKGIKLQGIASLYRTNITEIFTTSTVDKYDIYDLLFTESIKVRVIDVDLNDYSITLQVRLPLLTRLLNTQIYKVDSISYNIQNREWYIPLPSHIMTKGAFLGGADVKECIEAFSSYICPSDPGFVLNHEIESCLSGNISQCPRTTVTSDIVPRYAFVNGGVVANCITTTCTCNGIGNRINQPPDQGIKIITHKECSTIGINGMLFNTNKEGTLAFYTPNDITLNNSVALDPIDISIELNKAKSDLKESKEWIRRSNQKLDSIGNWHQSSTTIIIILIMIIILFIINVTIITIAIKYYRIQKRNRVDQNDEPYVLTNK

SEQ ID NO: 80 - DNA, 1851 bp, Guinea pig parainfluenza virus TS-9
aggacaaaagaggtcaataccaacaactattagcagtcatactcacaagaataagaaagaagggatttaaaaagttaaataggagaaataaaaacaaaaagtacagaacaccagagcgataaaatcaaaacatctaactcactcaaaacaaaaattccaaaagagaccggtaatacaacaagcattgagcacaatgccaatttcaatactgctgattattacaaccatgatcatggcatccttctgtcaaatagatatcacaaaactacatcatgtaggtgtattggtcaatagtcccaaagggatgaagatatcacaaaactttgaaacaagatatctgattttgagcctcataccaaaaatagaagactctaactcttgtggtgaccaacagatcaggcaatacaagaagctattggatagactgatcatccctttatatgatggattaagattacagaaagatgtgatagtaactaatcaagaatccaatgaaaacactgatcctagaacaaaacgattctttggaggggtaattggaactattgctctgggagtagcaacctcagcacaaattacagcagcagttgctttggtcgaagccaagcaggcaagatcagacatcgaaaaacttaaagaagcaattagggacacaaataaagcagtgcagtcagttcagagctccataggaaatctaatagtagcaattaaatcagtccaggattatgttaacaaagaaatcgtgccatcgattgcaaggctaggttgtgaagcagcaggacttcaattaggaattgcattaacacagcattactcagaattaacaaacatatttggtgataacataggatcgttacaagaaaaaggaataaaattacaaggtatagcatcattataccgcacaaacatcacagaaatattcacaacatcaacagttgataaatatgatatttatgatctgttatttacagaatcaataaaggtgagagttatagatgttgacttgaatgattactcaatcaccctccaagtcagactccctttattaactagattgctgaacactcagatctacaaagtagattccatatcatacaacatccaaaacagagaatggtatatccctcttcccagccacatcatgacgaaaggggcatttctaggtggagcagatgtcaaagaatgcatagaagcattcagcagctatatatgcccttctgatccaggatttgtattaaaccatgaaatagagagctgcttatcaggaaatatatctcaatgtccaagaaccacagtcacatcagacattgttccaagatatgcatttgtcaatggaggagtggttgcaaactgtataacaaccacttgtacatgcaacggaatcggtaatagaatcaatcaaccacctgatcaaggaataaaaattataacacataaagaatgtagtacaataggtatcaacggaatgctgttcaatacaaataaagaaggaactcttgcattctacacaccaaatgatataacactaaacaattctgttgcacttgatccaattgacatatcaatcgagctcaacaaggccaaatcagatctaaaagaatcaaaagaatggataagaaggtcaaatcaaaaactagattccattggaaattggcatcaatctagcactacaatcataattattttgataatgatcattatattatttataattaatgtaacgataattacaattgcaattaagtattacagaattcaaaagagaaatcgagtggatcaaaatgatgagccatatgtactaacaaacaaataacatatctacagatcattagatattaaaattataaaaaa

SEQ ID NO: 81 - protein, 353 aa, Human parainfluenza virus 3
MSITNSAIYTFPESSFSENGHIEPLPLKVNEQRKAVPHIRVAKIGNPPKHGSRYLDVFLLGFFEMERIKDKYGSVNDLDNDPGYKVCGSGSLPIGLVKYTGNIQELLQAATKLDIEVRRTVKAKEMIVYTVQNIKPELYPWSSRLRKGMLFDANKVALAPQCLPLDRSIKFRVIFVNCTAIGSITLFKIPKSMASLSLPSTISINLQVHIKTGVQTDSKGIVQILDEKGEKSLNFMVHLGLIKRKVGRMYSVEYCKQKIEKMRLIFSLGSVGGISLHVNATGSISKTLASQLVFKREICYPLMDLNPHLNLVIWASSVEITRVDAIFQPSLPGEFRYYPNIIAKGVGKIKQWN

SEQ ID NO: 82 - DNA, 1150 bp, Human parainfluenza virus 3
aggattaaagaataaattaatccttgtccaaaatgagtataactaactctgcaatatacacattcccggagtcatcattctctgagaatggtcatatagaaccattaccactcaaagtcaatgaacagagaaaagcagtacctcacattagagttgccaaaatcggaaatccaccaaaacatggatcccggtatttggatgtcttcttactcggcttcttcgagatggaacgaatcaaagacaaatacgggagtgtgaatgatcttgacaatgacccgggttacaaagtttgtggctctggatcattaccaatcggattagttaaatacactgggaatatccaggaattattacaggcagcaactaaactggacatagaagtgagaagaacagtcaaagcgaaagaaatgattgtttatacggtacaaaatataaaaccagaactgtacccatggtccagtagactaagaaaaggaatgttgttcgatgccaacaaagttgctcttgctcctcaatgtcttccactagataggagcataaaattcagagtaatcttcgttaattgtacggcaattggatcaataaccttgtttaaaattcccaagtcaatggcatcactatctctacccagcacaatatcaatcaatctgcaggtacacatcaaaacaggggttcagactgattctaaagggatagttcaaattttggatgagaagggtgaaaaatcactgaatttcatggtccatctcggattgatcaaaagaaaagtaggcagaatgtactctgtcgagtactgtaaacagaaaatcgagaaaatgagattgatattttctttgggatcagttggaggaatcagtcttcatgtcaatgcaactggatctatatcaaaaacactagcaagtcagctggtattcaaaagggagatttgttatcccttaatggatctaaatccacatctcaatctagttatctgggcttcatcagtagagattacaagagtggatgcaattttccaaccttctttacctggcgagttcagatactatcctaacattattgcaaaaggagttgggaaaatcaaacaatggaactagtaatctctattttgatctggatatatctattaagccaaagcaaataagagataatc

SEQ ID NO: 83 - protein, 572 aa, Human parainfluenza virus 3
MEYWKHTNHGKDAGNEPETSTATNGNKLTNKITYILWTITLMLLSIIFIIVLINSIKSEKARESLLQDINNEFMEVTEKIQVASDNTNDLIQSGVNTRLLTIQSHVQNYIPISLTQQISDLRKFISEITIRNDNQEVPPQRITHDVGIKPLNPDDFWRCTSGLPSLMKTPKIRLMPGPGLLAMPTTVDGCVRTPSLVINDLIYAYTSNLITRGCQDIGKSYQVLQIGIITVNSDLVPDLNPRISHTFNINDNRKSCSLALLNTDVYQLCSTPKVDERSDYASSGIEDIVLDIVNYDSSISTTRFKNNNISFDQPYAALYPSVGPGIYYKGKIIFLGYGGLEHPINENAICNTTGCPGKTQRDCNQASHSPWFSDRRMVNSIIVVDKGLNSVPKLKVWTISMRQNYWGSEGRLLLLGNKIYIYTRSTSWHSKLQLGIIDITDYSDIRIKWTWHNVLSRPGNNECPWGHSCPDGCITGVYTDAYPLNPTGSIVSSVILDSQKSRVSPVITYSTATERVNELAIRNKTLSAGYTATSCITHYNKGYCFHIVEINHKSLITFQPMLFKTEIPKSCS

SEQ ID NO: 84 - DNA, 1719 bp, Human parainfluenza virus 3
atggaatactggaagcacaccaatcacggaaaggatgctggtaatgagccggagacatccacagccactaatggcaacaagctcaccaacaagataacatatatattatggacgataaccctgatgttattatcaataatcttcatcatagtgctaattaattccatcaaaagtgaaaaggcccgcgaatcattgctacaagacataaataatgagtttatggaagttacagaaaagatccaagtggcatcggataatactaatgatctaatacaatcaggagtaaatacaaggcttcttacaattcagagtcatgtccagaattatataccaatatcattgacacaacaaatatcggatcttaggaaattcattagtgaaattacaattagaaatgataatcaagaagtgccaccacaaagaataacacatgatgtgggtataaaacctttaaatccagatgatttctggagatgcacatctggtcttccatctttgatgaaaactccaaaaataagattaatgccggggccaggattattagctatgccaacgactgttgatggctgtgtcagaactccgtccttagtgataaatgatctgatttatgcttacacctcaaatctaatcactcgaggttgccaagatatagggaaatcatatcaagtgttacagatagggataataactgtaaactcagacttggtacctgacttaaatcccaggatctctcataccttcaacataaatgacaatagaaagtcatgttctctagcactcctaaacacagatgtatatcaactgtgttcaactcccaaagttgatgaaagatcagattatgcatcatcaggcatagaagatattgtacttgatattgtcaattatgatagctcaatctcaacaacaagatttaagaataataatataagttttgaccaaccatatgcggcattatacccatctgttggaccagggatatactacaaaggcaaaataatatttcttgggtatggaggtcttgaacatccaataaatgagaatgcaatctgcaacacaactgggtgtcctgggaaaacacagagagactgcaatcaagcatctcatagtccatggttttcagatagaaggatggtcaactctatcattgttgttgacaagggtttaaactcagttccaaaattgaaggtatggacgatatcgatgagacaaaattactgggggtcagaaggaagattacttctactaggtaacaagatctacatatacacaagatctacaagttggcacagcaagttacaattaggaataattgacattactgactacagtgatataaggataaaatggacatggcataatgtgctatcaagaccaggaaacaatgaatgtccatggggacattcatgtccggatggatgtataacaggagtatatactgatgcatatccactcaatcccacaggaagcattgtatcatctgtcatattagactcacaaaaatcgagagtcagcccagtcataacttactcaacagcaaccgaaagggtaaacgagctggccatccgaaacaaaacactctcagctgggtatacagcaacaagctgcattacacactataacaaaggatattgttttcatatagtagaaataaatcataaaagcttaatcacatttcaacctatgttgttcaaaacagagattccaaaaagctgcagttaa

SEQ ID NO: 85 - protein, 572 aa, Human parainfluenza virus 3
MEYWKHTNHGKDVGNELETSTATHGNKLTNKITYILWTITLVLLSIVFIIVLTNSIKSEKARESLLQDINNEFMEVTEKIQVASDNTNDLIQSGVNTRLLTIQSHVQNYIPISLTQQISDLRKFISEITIRNDNQEVPPQRITHDVGIKPLNPDDFWRCTSGLPSLMKTPKIRLMPGPGLLAMPTTVDGCVRTPSLVINDLIYAYTSNLITRGCQDIGKSYQVLQIGIITVNSDLVPDLNPRISHTFNINDNRKSCSLALLNTDVYQLCSTPKVDERSDYASSGIEDLVLDIVNYDGSISTTRFKNNNISFDQPYAALYPSVGPGIYYKGKIIFLGYGGLEHPINENAICNTTECPGKTQRDCNQASHSPWFSDRRMVNSIIVVDKGLNSVPKLKVWSISMRQNYWGSEGRLLLLGNKIYIYTRSTSWHSKLQLGIIDITDYSDIRIKWTWHNVLSRPGNNECPWGHSCPDGCITGVYTDAYPLNPTGSIVSSVILDSQKSRVNPVITYSTATERVNELAIRNETLSAGYTTTSCITHYNKGYCFHIVEINHKSLNTFQPMLFKTEIPKSCS

SEQ ID NO: 86 - DNA, 1719 bp, Human parainfluenza virus 3
atggaatactggaagcacaccaaccacggaaaggatgttggtaatgagctggaaacatccacagccactcatggcaacaagctcaccaacaagataacatatatattatggacgataaccctggtgttattatcaatagtcttcatcatagtgctaactaattccatcaaaagtgaaaaggcccgcgaatcattgctacaagacataaataatgagtttatggaagttacagaaaagatccaagtggcatctgataatactaatgatctaatacagtcaggagtgaatacaaggcttcttacaattcagagtcatgtccagaattatataccaatatcattgacacaacaaatatcggatcttaggaaattcattagtgaaattacaattagaaatgataatcaagaagtgccaccacaaagaataacacatgatgtaggtataaaacctttaaatccagatgatttctggagatgcacgtctggtcttccatctttaatgaaaactccaaaaataagattaatgccgggcccaggattattagctatgccaacgactgttgatggctgtgtcagaaccccgtccttagtgataaatgatctgatttatgcttacacctcaaatctaattactcgaggttgccaggatatagggaaatcatatcaagtattacagatagggataataactgtaaactcagacttggtacctgacttaaatcctaggatctctcataccttcaacataaatgacaatagaaagtcatgttctctagcactcctaaatacagatgtatatcaactgtgttcaactccaaaagttgatgaaagatcagattatgcatcatcaggcatagaagatcttgtacttgatattgtcaattatgatggctcaatctcaacaacaagatttaagaataataatataagttttgatcaaccatatgcggcattatacccatctgttggaccagggatatactacaaaggcaaaataatatttctcgggtatggaggtcttgaacatccaataaatgagaatgcaatctgcaacacaactgagtgtcctgggaaaacacagagagactgcaatcaggcatctcacagtccatggttttcagatagaaggatggtcaactctataattgttgttgacaagggtttaaactcagttccaaaattgaaggtatggtcgatatctatgagacaaaattactgggggtcagaaggaagattacttctactaggtaacaagatctacatatacacaagatctacaagttggcacagcaagttacaattaggaataattgacattactgactacagtgatataaggataaaatggacatggcataatgtgctatcaagaccaggaaacaatgaatgtccatggggacattcatgtccggatggatgtataacgggagtatatactgatgcatatccactcaatcccacaggaagcattgtatcatctgtcatattggactcacaaaaatcgagagtcaacccagtcataacttactcaacagcaaccgaaagggtaaacgagctggccatccgaaacgaaacactctcagctgggtatacaacaacaagttgcattacacactataacaaagggtattgttttcatatagtagaaataaatcataaaagcttaaacacatttcaacccatgttgttcaaaacagagattccaaaaagctgcagttaa

SEQ ID NO: 87 - protein, 572 aa, Human parainfluenza virus 3
MEYWKHTNHGKDAGNELETSMATNGNKLTNKITYILWTIILVLLSIVFIIVLINSIKSEKAHESLLQDINNEFMEITEKIQMASDNTNDLIQSGVNTRLLTIQSHVQNYIPISLTQQMSDLRKFISEITIRNDNQEVLPQRITHDVGIKPLNPDDFWRCTSGLPSLMKTPKIRLMPGPGLLAMPTTVDGCIRTPSLVINDLIYAYTSNLITRGCQDIGKSYQVLQIGIITVNSDLVPDLNPRISHTFNINDNRKSCSLALLNTDVYQLCSTPKVDERSDYASSGIEDIVLDIVNYDGSISTTRFKNNNISFDQPYAALYPSVGPGIYYKGKIIFLGYGGLEHPINENVICNTTGCPGKTQRDCNQASHSPWFSDRRMVNSIIVVDKGLNSIPKLKVWTISMRQNYWGSEGRLLLLGNKIYIYTRSTSWHSKLQLGIIDITDYSDIRIKWTWHNVLSRPGNNECPWGHSCPDGCITGVYTDAYPLNPTGSIVSSVILDSQKSRVNPVITYSTATERVNELAIRNRTLSAGYTTTSCITHYNKGYCFHIVEINQKSLNTLQPMLFKTEVPKSCS

SEQ ID NO: 88 - DNA, 1832 bp, Human parainfluenza virus 3
gacaaatccaaattcgagatggaatactggaagcataccaatcacggaaaggatgctggcaatgagctggagacgtccatggctactaatggcaacaagctcaccaataagataacatatatattatggacaataatcctggtgttattatcaatagtcttcatcatagtgctaattaattccatcaaaagtgaaaaggctcatgaatcattgctgcaagacataaataatgagtttatggaaattacagaaaagatccaaatggcatcggataataccaatgatctaatacagtcaggagtgaatacaaggcttcttacaattcagagtcatgtccagaattatataccaatatcactgacacaacagatgtcagatcttaggaaattcattagtgaaattacaattagaaatgataatcaagaagtgctgccacaaagaataacacatgatgtgggtataaaacctttaaatccagatgatttttggagatgcacgtctggtcttccatctttaatgaaaactccaaaaataaggttaatgccagggccgggattattagctatgccaacgactgttgatggctgtatcagaactccgtccttagttataaatgatctgatttatgcttatacctcaaatctaattactcgaggttgtcaggatataggaaaatcatatcaagtcttacagatagggataataactgtaaactcagacttggtacctgacttaaatcccaggatctctcatacttttaacataaatgacaataggaagtcatgttctctagcactcctaaatacagatgtatatcaactgtgttcaactcccaaagttgatgaaagatcagattatgcatcatcaggcatagaagatattgtacttgatattgtcaattatgatggctcaatctcaacaacaagatttaagaataataacataagctttgatcaaccttatgctgcactatacccatctgttggaccagggatatactacaaaggcaaaataatatttctcgggtatggaggtcttgaacatccaataaatgagaatgtaatctgcaacacaactgggtgtcccgggaaaacacagagagactgcaatcaggcatctcatagtccatggttttcagataggaggatggtcaactctatcattgttgttgacaaaggcttaaactcaattccaaaattgaaggtatggacgatatctatgagacagaattactgggggtcagaaggaaggttacttctactaggtaacaagatctatatatatacaagatccacaagttggcatagcaagttacaattaggaataattgatattactgattacagtgatataaggataaaatggacatggcataatgtgctatcaagaccaggaaacaatgaatgtccatggggacattcatgtccagatggatgtataacaggagtatatactgatgcatatccactcaatcccacagggagcattgtgtcatctgtcatattagattcacaaaaatcgagagtgaacccagtcataacttactcaacagcaaccgaaagagtaaacgagctggccatccgaaacagaacactctcagctggatatacaacaacaagctgcatcacacactataacaaaggatattgttttcatatagtagaaataaatcagaaaagcttaaacacacttcaacccatgttgttcaagacagaggttccaaaaagctgcagttaatcataattaaccgcaatatgcattaacctatctataatacaagtatatgataagtaatcagcaatcagacaatagacaaaagggaaatataaaaa

SEQ ID NO: 89 - DNA, 12 bp, Artificial Sequence
  Synthetic
gacgacgacaag

SEQ ID NO: 90 - DNA, 14 bp, Artificial Sequence
  Synthetic
gaggagaagcccgg

SEQ ID NO: 91 - protein, 6 aa, Artificial Sequence
  Synthetic
HHHHHH

SEQ ID NO: 92 - protein, 10 aa, Artificial Sequence
  Synthetic
EQKLISEEDL

SEQ ID NO: 93 - protein, 8 aa, Artificial Sequence
  Synthetic
DYKDDDDK

SEQ ID NO: 94 - protein, 8 aa, Artificial Sequence
  Synthetic
WSHPQFEK

SEQ ID NO: 95 - protein, 9 aa, Artificial Sequence
  Synthetic
YPYDVPDYA

SEQ ID NO: 96 - DNA, 15 bp, Artificial Sequence
  Synthetic
gacgacgacaagatg

SEQ ID NO: 97 - DNA, 17 bp, Artificial Sequence
  Synthetic
taaccgggcttctcctc

SEQ ID NO: 98 - DNA, 17 bp, Artificial Sequence
  Synthetic
gaggagaagcccggtta

SEQ ID NO: 99 - DNA, 15 bp, Artificial Sequence
  Synthetic
catcttgtcgtcgtc

SEQ ID NO: 100 - DNA, 15 bp, Artificial Sequence
  Synthetic
ccgggcttctcctca

SEQ ID NO: 101 - DNA, 16 bp, Artificial Sequence
  Synthetic
tcttgtcgtcgtcatc

SEQ ID NO: 102 - DNA, 18 bp, Artificial Sequence
  Synthetic
  CDS (1)..(18)
gatgacgacgacaagatg

SEQ ID NO: 103 - protein, 6 aa, Artificial Sequence
  Synthetic Construct
DDDDKM

SEQ ID NO: 104 - DNA, 18 bp, Artificial Sequence
  Synthetic
taaccgggcttctcctca

SEQ ID NO: 105 - DNA, 18 bp, Artificial Sequence
  Synthetic
tgaggagaagcccggtta

SEQ ID NO: 106 - DNA, 18 bp, Artificial Sequence
  Synthetic
catcttgtcgtcgtcatc

SEQ ID NO: 107-113 - skipped (7 entries)

SEQ ID NO: 114 - protein, 469 aa, Influenza virus
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 115 - protein, 219 aa, canine distemper virus
MEVKVENIRAIDMLKARVKNRVARSKCFKNASLILIGITTLSIALNIYLIINYTIQKTSSESEHHTSSPPTESNKEASTISTDNPDINPNSQHPTQQSTENPTLNPAASVSPSETEPASTPDTTNRLSSVDRSTAQPSESRTKTKPTVHTRNNPSTASSTQSPPRATTKAIRRATTFRMSSTGKRPTTTSVQSDSSTTTQNHEETGSANPQASVSTMQN

SEQ ID NO: 116 - protein, 264 aa, Avian Metapneumovirus
MEVKVENVGKSQELKVKVKNFIKRSDCKKKLFALILGLVSFELTMNIMLSVMYVESNEALSLCRIQGTPAPRDNKTNTENATKETTLHTTTTTRDPEVRETKTTKPQANEGATNPSRNLTTKGDKHQTTRATTEAELEKQSKQTTEPGTSTQKHTPARPSSKSPTTTQATAQPTTPTAPKASTAPKNRQATTKKTETDTTTASRARNTNNPTETATTTPKATTETGKGKEGPTQHTTKEQPETTARETTTPQPRRTAGASPRAS

SEQ ID NO: 117 - protein, 219 aa, Human Metapneumovirus; identical to SEQ ID NO: 115

SEQ ID NO: 118 - protein, 299 aa, Human Respiratory Syncytial Virus
MSKHKNQRTARTLEKTWDTLNHLIVISSCLYRLNLKSIAQIALSVLAMIISTSLIIAAIIFIISANHKVTLTTVTVQTIKNHTEKNITTYLTQVPPERVSSSKQPTTTSPIHTNSATTSPNTKSETHHTTAQTKGRTTTSTQTNKPSTKPRLKNPPKKPKDDYHFEVFNFVPCSICGNNQLCKSICKTIPSNKPKKKPTIKPTNKPTTKTTNKRDPKTPAKTTKKETTTNPTKKPTLTTTERDTSTSQSTVLDTTTLEHTIQQQSLHSTTPENTPNSTQTPTASEPSTSNSTQNTQSHA

SEQ ID NO: 119 - protein, 465 aa, Influenza B virus
MLPSTIQTLTLFLTSGGVLLSLYVSALLSYLLYSDILLKFSPKIIAPTTSLDCANASNVQAVNHSATKEMKFLPPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGSGGVKGGFVHQRMASKIGRWYSRTMSKTKRMGMELYVKYDGDPWTDSDALAPSGVMVSMEEPGWYSFGFEIKDKKCDVPCIGIEMVHDGGKRTWHSAATAIYCLMGSGQLLWDTVTGVNMAL

SEQ ID NO: 120 - protein, 449 aa, Influenza virus
MNPNQKIITIGSICMVIGIVSLMLQIGNMISIWVSHSIQTGNQHQAEPISNTNFLTEKAVASVTLAGNSSLCPISGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 121 - protein, 467 aa, Influenza virus
MNPNQKIIALGSVSITIATICLLMQIAILATTMTLHFNECTNPSNNQAVPCEPIIIERNITEIVHLNNTTIEKESCPKVAEYKNWSKPQCQITGFAPFSKDNSIRLSAGGDIWVTREPYVSCGLGKCYQFALGQGTTLNNKHSNGTIHDRSPHRTLLMNELGVPFHLGTKQVCIAWSSSSCHDGKAWLHVCVTGDDRNATASIIYDGMLTDSIGSWSKNILRTQESECVCINGTCTVVMTDGSASGRADTKILFIREGKIVHIGPLSGSAQHVEECSCYPRYPEVRCVCRDNWKGSNRPVLYINVADYSVDSSYVCSGLVGDTPRNDDSSSSSNCRDPNNERGGPGVKGWAFDNGNDVWMGRTIKKDSRSGYETFRVVGGWTTANSKSQINRQVIVDSDNWSGYSGIFSVEGKTCINRCFYVELIRGRPQETRVWWTSNSIIVFCGTSGTYGTGSWPDGANINFMSI

SEQ ID NO: 122 - protein, 469 aa, Influenza virus
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 123 - protein, 469 aa, Influenza virus
MNPNQKIITIGVVNTTLSTIALLIGVGNLVFNTVIHEKIGNHQTVIHPTITTPAVPNCSDTIITYNNTVINNITTTIITEAERLFKPPLPLCPFRGFFPFHKDNAIRLGENKDVIVTREPYVSCDNDNCWSFALAQGALLGTKHSNGTIKDRTPYRSLIRFPIGTAPVLGNYKEICIAWSSSSCFDGKEWMHVCMTGNDNDASAQIIYAGRMTDSIKSWRKDILRTQESECQCIGGTCVVAVTDGPAANSADHRVYWIREGRIVKYENVPKTKIQHLEECSCYVDIDVYCICRDNWKGSNRPWMRINNETILETGYVCSKFHSDTPRPADPSTVSCDSPSNINGGPGVKGFGFKAGNDVWLGRTVSTSGRSGFEIIKVTDGWINSPNHAKSVTQTLVSNNDWSGYSGSFIVKTKGCFQPCFYVELIRGRPNKNDDVSWTSNSIVTFCGLDNEPGSGNWPDGSNIGFMPK

SEQ ID NO: 124 - protein, 617 aa, Measles virus
MSPQRDRINAFYKDNPHPKGSRIVINREHLMIDRPYVLLAVLFVMFLSLIGLLAIAGIRLHRAAIYTAENHKSLSTNLDVTNSIEHQVKDVLTPLFKIIGDEVGLRTPQRFTDLVKFISDKIKFLNPDREYDFRDLTWCINPPERIKLDYDQYCADVAAEELMNALVNSTLLEARATNQFLAVSKGNCSGPTTIRGQFSNMSLSLLDLYLSRGYNVSSIVTMTSQGMYGGTYLVEKPNLSSKGSELSQLSMHRVFEVGVIRNPGLGAPVFHMTNYFEQPVSNDFSNCMVALGELKFAALCHREDSITIPYQGSGKGVSFQLVKLGVWKSPTDMRSWVPLSTDDPVIDRLYLSSHRGVIADNQAKWAVPTTRTDDKLRMETCFQQACKGKNQALCENPEWAPLKDNRIPSYGVLSVNLSLTVELKIKIASGFGPLITHGSGMDLYKTNHNNVYWLTIPPMKNLALGVINTLEWIPRFKVSPNLFTVPIKEAGEDCHAPTYLPAEVDGDVKLSSNLVILPGQDLQYVLATYDTSRVEHAVVYYVYSPSRSFSYFYPFRLPIKGVPIELQVECFTWDKKLWCRHFCVLADSESGGHITHSGMVGMGVSCTVTREDGTNRR

SEQ ID NO: 125 - protein, 582 aa, Mumps virus
MEPSKLFIMSDNATFAPGPVVNAAGKKTFRTCFRILVLSVQAVTLILVIVTLGELIRMINDQGLSNQLSSITDKIRESAAMIASAVGVMNQVIHGVTVSLPLQIEGNQNQLLSTLATICTNRNQVSNCSTNIPLVNDLRFINGINKFIIEDYATHDFSIGHPLNMPSFIPTATSPNGCTRIPSFSLGKTHWCYTHNVINANCKDHTSSNQYVSMGILVQTASGYPMFKTLKIQYLSDGLNRKSCSIATVPDGCAMYCYVSTQLETDDYAGSSPPTQKLTLLFYNDTIKERTISPSGLEGNWATLVPGVGSGIYFENKLIFPAYGGVLPNSTLGVKSAREFFRPVNPYNPCSGPPQELDQRALRSYFPSYFSSRRVQSAFLVCAWNQILVTNCELVVPSNNQTLMGAEGRVLLINNRLLYYQRSTSWWPYELLYEISFTFTNSGQSSVNMSWIPIYSFTRPGLGKCSGENICPTVCVSGVYLDPWPLTPYSHQSGINRNFYFTGALLNSSTTRVNPTLYVSALNNLKVLAPYGTQGLFASYTTTTCFQDTGDASVYCVYIMELASNIVGEFQILPVLARLTIT

SEQ ID NO: 126 - protein, 602 aa, Nipah virus
MPAENKKVRFENTTSDKGKIPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 127 - protein, 571 aa, Parainfluenza virus
MEDYSNLSLKSIPKRTCRIIFRTATILGICTLIVLCSSILHEIIHLDVSSGLMDSDDSQQGIIQPIIESLKSLIALANQILYNVAIIIPLKIDSIETVIFSALKDMHTGSMSNTNCTPGNLLLHDAAYINGINKFLVLKSYNGTPKYGPLLNIPSFIPSATSPNGCTRIPSFSLIKTHWCYTHNVMLGDCLDFTTSNQYLAMGIIQQSAAAFPIFRTMKTIYLSDGINRKSCSVTAIPGGCVLYCYVATRSEKEDYATTDLAELRLAFYYYNDTFIERVISLPNTTGQWATINPAVGSGIYHLGFILFPVYGGLISGTPSYNKQSSRYFIPKHPNITCAGNSSEQAAAARSSYVIRYHSNRLIQSAVLICPLSDMHTARCNLVMFNNSQVMMGAEGRLYVIDNNLYYYQRSSSWWSASLFYRINTDFSKGIPPIIEAQWVPSYQVPRPGVMPCNATSFCPANCITGVYADVWPLNDPEPTSQNALNPNYRFAGAFLRNESNRTNPTFYTASASALLNTTGFNNTNHKAAYTSSTCFKNTGTQKIYCLIIIEMGSSLLGEFQIIPFLRELIP

SEQ ID NO: 128 - protein, 572 aa, Parainfluenza virus; identical to SEQ ID NO: 87

SEQ ID NO: 129 - protein, 575 aa, Parainfluenza virus
MAEKGKTNSSYWSTTRNDNSTVNTHINTPAGRTHIWLLIATTMHTVLSFIIMILCIDLIIKQDTCMKTNIMTVSSMNESAKIIKETITELIRQEVISRTINIQSSVQSGIPILLNKQSRDLTQLIEKSCNRQELAQICENTIAIHHADGISPLDPHDFWRCPVGEPLLSNNPNISLLPGPSLLSGSTTISGCVRLPSLSIGDAIYAYSSNLITQGCADIGKSYQVLQLGYISLNSDMYPDLNPVISHTYDINDNRKSCSVIAAGTRGYQLCSLPTVNETTDYSSEGIEDLVFDILDLKGKTKSHRYKNEDITFDHPFSAMYPSVGSGIKIENTLIFLGYGGLTTPLQGDTKCVINRCTNVNQSVCNDALKITWLKKRQVVNVLIRINNYLSDRPKIVVETIPITQNYLGAEGRLLKLGKKIYIYTRSSGWHSNLQIGSLDINNPMTIKWAPHEVLSRPGNQDCNWYNRCPRECISGVYTDAYPLSPDAVNVATTTLYANTSRVNPTIMYSNTSEIINMLRLKNVQLEAAYTTTSCITHFGKGYCFHIVEINQASLNTLQPMLFKTSIPKICKITS

SEQ ID NO: 130 - protein, 315 aa, respiratory syncytial virus
MSKNKNQRTARTLEKTWDTLNHLIVISSCLYKLNLKSIAQIALSVLAMIISTSLIIAAIIFIISANHKVTLTTVTVQTIKNHTEKNITTYLTQVSPERVSPSKQPTTTPPIHTNSATISPNTKSETHHTTAQTKGRTTTPTQNNKPSTKPRPKNPPKKPKDDYHFEVFNFVPCSICGNNQLCKSICKTIPSNKPKKKPTIKPTNKPPTKTTNKRDSKTLAKTLKKETTINPTKKPTPKTTERDTSTLQSIVLDTTTSKHTERDTSTSQSIVLDTTTSKHTIQQQSLHSTTPENTPNSTQTPTASEPSTSNSNQKL

SEQ ID NO: 131 - protein, 351 aa, Vaccinia virus
MTMKMMVHIYFVSLLLLLFHSYAIDIENEITEFFNKMRDTLPAKDSKWLNPACMFGGTMNDIAALGEPFSAKCPPIEDSLLSHRYKDYVVKWERLEKNRRRQVSNKRVKHGDLWIANYTSKFSNRRYLCTVTTKNGDCVQGIVRSHIKKPPSCIPKTYELGTHDKYGIDLYCGILYAKHYNNITWYKDNKEINIDDIKYSQTGKKLIIHNPELEDSGRYNCYVHYDDVRIKNDIVVSRCKILTVIPSQDHRFKLILDPKINVTIGEPANITCTAVSTSLLIDDVLIEWENPSGWLIGFDFDVYSVLTSRGGITEATLYFENVTEEYIGNTYKCRGHNYYFEKTLTTTVVLE

SEQ ID NO: 132 - DNA, 1410 bp, Influenza virus
atgaatccaaatcaaaagataataacgattggctctgtttctctcaccatttccacaatatgcttcttcatgcaaattgccatcctgataactactgtaacattgcatttcaagcaatatgaattcaactcccccccaaacaaccaagtgatgctgtgtgaaccaacaataatagaaagaaacataacagagatagtgtatctgaccaacaccaccatagagaaggaaatatgccccaaactagcagaatacagaaattggtcaaagccgcaatgtaacattacaggatttgcacctttttctaaggacaattcgattcggctttccgctggtggggacatctgggtgacaagagaaccttatgtgtcatgcgatcctgacaagtgttatcaatttgcccttggacagggaacaacactaaacaacgtgcattcaaatgacacagtacatgataggaccccttatcggaccctattgatgaatgagttgggtgttccatttcatctggggaccaagcaagtgtgcatagcatggtccagctcaagttgtcacgatggaaaggcatggctgcatgtttgtgtaacgggggatgatgaaaatgcaactgctagcttcatttacaatgggaggcttgtagatagtattgtttcatggtccaaaaaaatcctcaggacccaggagtcagaatgcgtttgtatcaatggaacttgtacagtagtaatgactgatgggagtgcttcaggaaaagctgatactaaaatactattcattgaggaggggaaaatcgttcatactagcacattgtcaggaagtgctcagcatgtcgaggagtgctcctgttatcctcgatatcctggtgtcagatgtgtctgcagagacaactggaaaggctccaataggcccatcgtagatataaacataaaggattatagcattgtttccagttatgtgtgctcaggacttgttggagacacacccagaaaaaacgacagctccagcagtagccattgcttggatccaaacaatgaggaaggtggtcatggagtgaaaggctgggcctttgatgatggaaatgacgtgtggatgggaagaacgatcagcgagaagttacgctcaggatatgaaaccttcaaagtcattgaaggctggtccaaccctaactccaaattgcagataaataggcaagtcatagttgacagaggtaataggtccggttattctggtattttctctgttgaaggcaaaagctgcatcaatcggtgcttttatgtggagttgataaggggaagaaaacaagaaactgaagtcttgtggacctcaaacagtattgttgtgttttgtggcacctcaggtacatatggaacaggctcatggcctgatggggcggacatcaatctcatgcctatataa

SEQ ID NO: 133 - DNA, 799 bp, Avian Metapneumovirus
atggaggtcaaggtagagaatgttggcaagtcacaggagcttaaagttaaagtcaagaattttataaaaaggtctgattgcaagaaaaaactttttgccttgattttagggctagtcagctttgaactcactatgaatataatgctgtctgtcatgtatgtggagtcaaatgaggccctaagtttatgtaggatccaagggactcctgctccaagagataataagacaaacacagaaaacgcaacaaaggaaacaacactccacacaacgaccacaacaagggatccagaggtgagggaaacaaaaaccaccaagccccaggccaatgaaggagcaacaaacccaagcaggaacctcaccaccaagggagacaaacaccaaacgacaagagcaacaacagaggcagaactggaaaaacaaagcaagcaaaccacagagccaggcaccagcacccaaaagcacacccccgcaaggccaagcagcaaatcccccaccacaacacaagcaacagcacaaccgacaacaccaacagccccaaaagcaagcacagcacccaagaacagacaggcaacaaccaaaaaaaccgaaacggacaccacaacagcaagcagagcaaggaacaccaacaaccccacagagacagcaacaacaacccccaaagcaacaacagaaacaggcaagggcaaagaggggccaacacagcacacaaccaaagaacagcccgagacaacagcacgagagacaacaaccccacagccaagaagaacagccggagctagcccaagagcaagttagttaa

SEQ ID NO: 134 - DNA, 669 bp, Human Metapneumovirus
atggaggtgaaagtagagaacattcgagcaatagacatgctcaaagcaagagtgaaaaatcgtgtggcacgtagcaaatgctttaaaaatgcttctttaatcctcataggaataactacactgagtatagctctcaatatctatctgatcataaactacacaatacaaaaaacctcatctgaatcagaacaccacaccagctcaccacccacagaatccaacaaggaagcttcaacaatctccacagacaacccagacatcaatccaaactcacagcatccaactcaacagtccacagaaaaccccacactcaaccccgcagcatcagtgagcccatcagaaacagaaccagcatcaacaccagacacaacaaaccgcctgtcctccgtagacaggtccacagcacaaccaagtgaaagcagaacaaagacaaaaccgacagtccacacaagaaacaacccaagcacagcttccagtacacaatccccaccacgggcaacaacgaaggcaatccgcagagccaccactttccgcatgagcagcacaggaaaaagaccaaccacaacatcagtccagtccgacagcagcaccacaacccaaaatcatgaagaaacaggttcagcgaacccacaggcatctgtaagcacaatgcaaaactagcacaccaac

SEQ ID NO: 135 - DNA, 1350 bp, Influenza virus
atgaatccaaatcagaagataataaccatcggatcaatctgtatggtaattggaatagttagcttaatgttacaaattgggaacatgatctcaatatgggtcagtcattcaattcagacagggaatcaacaccaagctgaaccaatcagcaatactaattttcttactgagaaagctgtggcttcagtaacattagcgggcaattcatctctttgccccattagcggatgggctgtacacagtaaggacaacagtataaggatcggttccaagggggatgtgtttgttataagagagccgttcatctcgtgctcccacttagaatgtagaactttctttttgactcagggagccttgctgaatgacaagcactccaatgggactgttaaagacagaagccctcacagaacattaatgagttgtcctgtgggtgaggctccctccccatataactcaaggtttgagtctgttgcttggtcagcaagtgcttgccatgatggcaccagttggttgacaattggaatttcgggcccagacaatggggctgtggctgtattgaagtacaatggcataataacagacactatcaagagttggaggaacaacatactgagaactcaagagtctgaatgtgcatgtgtaaatggctcttgctttactgtaatgactgatggaccaagtaatgggcaggcatcatataaaatcttcaagatggaaaaagggaaagtggttaaatcagtcgaattggatgctcctaattatcattatgaggagtgctcctgttatcctgatgccggcgaaatcacatgtgtgtgcagggataattggcatggctcaaataggccatgggtatctttcaatcaaaatttggagtatcaaatagggtatatatgcagtggagttttcggagacaatccacgccccaatgatggaacaggtagttgtggtccggtgtcccctaacggggcatatggggtaaaagggttttcatttaaatacggcaatggtgtttggatcgggagaaccaaaagcactaattccaggagcggctttgaaatgatttgggatccaaatgggtggactggaacagacagtagcttttcggtgaaacaagatatcgtagcaataactgattggtcaggatatagcgggagttttgtccagcatccagaactgacaggattagattgcataagaccttgtttctgggttgagttaatcagagggcggcccaaagagagcacaatttggactagtgggagcagcatatccttttgtggtgtaaatagtgacactgtgggttggtcttggccagacggtgctgagttgccattcaccattgacaagtag

SEQ ID NO: 136 - DNA, 1410 bp, Influenza virus
atgaatccaaatcaaaagataataacgattggctctgtttctctcaccattgccacaatatgcttccttatgcaaattgccatcctggtaactactgtaacattgcatttcaagcaatatgaatgcaactcccccccaaacaaccaagtgatgctgtgtgaaccaacaataatagaaagaaacataacagagatagtgtatctgaccaacaccaccatagagaaggaaatatgccccaaactagcagaatacagaaattggtcaaagccgcaatgtaacattacaggatttgcacctttttctaaggacaattcgattcggctttccgctggtggggacatctgggtgacaagagaaccttatgtgtcatgcgatcctgacaagtgttatcaatttgcccttggacagggaacaacactaaacaacggacattcaaatgacacagtacatgataggaccccttatcggaccctattgatgaatgagttgggtgttccatttcatttgggaaccaagcaagtgtgcatagcatggtccagctcaagttgtcacgatggaaaagcatggctgcatgtttgtgtaacgggggatgatgaaaatgcaactgctagcttcatttacaatgggaggcttgtagatagtattggttcatggtccaaaaaaatcctcaggacccaggagtcggaatgcgtttgtatcaatggaacttgtacagtagtaatgactgatgggagtgcttcaggaaaagctgatactaaaatactattcattgaggaggggaaaatcgttcatactagcctattgtcaggaagtgctcagcatgtcgaggagtgctcctgttatcctcgataccctggtgtcagatgtgtctgcagagacaactggaaaggctccaataggcccatcgtagatataaatgtaaaggattatagcattgtttccagttatgtgtgctcaggacttgttggagacacacccagaaaaaacgacagctccagcagtagccattgcttggatcctaacaatgaggaaggtggtcatggagtgaaaggctgggcctttgatgatggaaatgacgtgtggatgggaagaacgatcagcgagaagttacgctcaggatatgaaaccttcaaagtcattgaaggctggtccaaacctaactccaaattgcagataaataggcaagtcatagttgacagaggtaataggtccggttattctggtattttctctgttgaaggcaaaagctgcatcaatcggtgcttttatgtggagttgataaggggaaggaaacaggaaactgaagtcttgtggacctcaaacagtattgttgtgttttgtggcacctcaggtacatatggaacaggctcatggcctgatggggcggacatcaatctcatgcctatataa

SEQ ID NO: 137 - DNA, 1419 bp, Influenza virus
atgaatccaaatcagaagataataacaatcggggtagtgaacactactctatcaacaatagcccttctcattggagtgggaaatctggttttcaacacagtcatacatgagaaaatagggaatcaccaaacagtgattcacccaacaataacgactcctgcagtaccaaactgcagtgacactataataacatacaacaacactgtgataaacaacataacaacaacaataataactgaagcggaaaggctttttaagcctccactgccgctgtgccccttccgaggattcttcccttttcacaaggacaatgcaatacgattgggtgagaacaaggacgtcatagtcacaagagaaccttatgttagctgtgataatgacaattgttggtccttcgctctcgcacaaggagcactgttagggactaaacatagcaatggaaccatcaaagacagaacaccgtataggtctctaatccgattcccaataggaacagccccagtactgggaaattacaaggagatatgcattgcttggtcgagtagcagttgctttgacgggaaagagtggatgcatgtatgcatgacagggaacgataatgatgcaagtgcccaaataatatatgcagggagaatgacagactccatcaaatcatggagaaaggacatactaaggacccaagagtccgaatgtcaatgcattggcggaacttgtgttgttgctgttacagatggccctgctgctaatagtgcagatcatagggtttattggatacgggaggggagaatagtgaagtatgaaaatgtccctaaaacaaagatacaacacttagaagagtgttcctgctatgtggacatcgatgtgtactgtatatgcagggacaattggaagggttccaacagaccttggatgagaatcaacaacgagaccatactggaaacaggatatgtgtgcagcaaatttcactcagacactcccaggccagctgacccctcaacagtatcatgtgattctccaagcaacattaatggaggacccggagttaagggatttggcttcaaagccggcaatgatgtgtggttgggcaggacagtgtcaactagtggtagatcaggctttgaaatcatcaaagttacagatgggtggatcaactctcccaatcacgccaaatcagttacacaaacactagtgtccaacaatgattggtcaggctattcaggtagtttcattgtcaaaaccaagggctgtttccagccctgcttttatgtcgaacttatacgaggaaggcccaacaagaatgatgatgtctcttggacaagcaatagtatagttactttctgtgggttagacaatgaacctggatcgggaaattggccggatggttccaacattgggtttatgcccaagtaacagaaaaaa

SEQ ID NO: 138 - DNA, 1953 bp, Measles virus
agggtgcaagatcatccacaatgtcaccacaacgagaccgaataaatgccttctacaaagacaacccacatcctaagggaagtaggatagttattaacagagaacatcttatgattgatagaccttatgttttgctggctgttctattcgtcatgtttctgagcttgatcgggttgctagccattgcaggcattagactccatcgtgcagccatctacaccgcagagaaccataagagcctcagcaccaatctagatgtaactaactcaatcgagcatcaggtcaaggacgtgctgacaccactcttcaagatcattggtgatgaagtgggcctgaggacacctcagagattcactgacctagtgaaattcatctctgacaaaattaaattccttaatccggatagggagtacgacttcagagatctcacttggtgtatcaacccgccagagagaatcaaattggattatgatcaatactgtgcagatgtggctgctgaagaactcatgaatgcattggtgaactcaactctactggaggccagggcaaccaatcagttcctagctgtctcaaagggaaactgctcagggcccactacaatcagaggtcaattctcaaacatgtcgctgtccctgttggacttgtatttaagtcgaggttacaatgtatcgtctatagtcactatgacatcccagggaatgtacgggggaacttacctagtggaaaagcctaatctgagcagtaaagggtcagagttgtcacaactgagcatgcaccgagtgtttgaagtaggggttatcagaaatccgggtttgggggctccggtgttccatatgacaaactattttgagcaaccagtcagtaatgatttcagcaactgcatggtggctttgggggagcttaaattcgcagccctctgtcacagggaagattctatcacaattccctatcaggggtcagggaaaggtgtcagcttccagctcgtcaagctaggtgtctggaaatccccaaccgacatgcgatcctgggtccccctatcaacggatgatccagtgatagataggctttacctctcatctcacagaggtgttatcgctgacaatcaagcaaaatgggctgtcccgacaacacggacagatgacaagttgcgaatggagacatgcttccagcaggcgtgtaagggtaaaaaccaagcactctgcgagaatcccgagtgggcaccattgaaggataacaggattccttcatacggggtcttgtctgttaatctgagtctgacagttgagcttaaaatcaaaattgcttcaggattcgggccattgatcacacacggttcagggatggacctatacaaaaccaaccacaacaatgtgtattggctgactatcccgccaatgaagaacctagccttaggtgtaatcaacacattggagtggataccgagattcaaggttagtcccaacctcttcactgttccaatcaaggaagcaggcgaggactgccatgccccaacatacctacctgcggaggtggatggtgatgtcaaactcagttccaatctggtaattctacctggtcaggatctccaatatgttttggcaacctacgatacttccagggttgaacatgctgtggtttattatgtttacagcccaagccgctcattttcttacttttatccttttaggttgcctataaagggggtcccaatcgaattacaagtggaatgcttcacatgggacaaaaaactctggtgccgtcacttctgtgtgcttgcggactcagaatctggtggacatatcactcactctgggatggtgggcatgggagtcagctgcacagtcactcgggaagatggaaccaatcgcagatagggctgccagtgaaccgatcacatgatgtcacccagacatcaggcatacccactagtgtgaaatagacatcagaattaag

SEQ ID NO: 139 - DNA, 1821 bp, Mumps virus
atggagccctcgaaactattcataatgtcggacaacgccacctttgcacctggacctgttgttaatgcggctggtaagaagacattccgaacctgtttccgaatattggtcctatctgtacaagcagttacccttatattggttattgtcactttaggtgagcttattaggatgatcaatgatcaaggcttgagcaatcagttgtcttcaattacagacaagataagagaatcagctgctatgattgcatctgctgtgggagtaatgaatcaagtaattcatggagtaacggtatccttacccctacaaattgagggaaaccaaaatcaattattatccacacttgccacaatctgcacaaacagaaaccaagtttcaaactgctctacaaacatccccttagttaatgaccttaggtttataaatggaatcaataagttcatcattgaagattatgcaacccatgatttctccatcggccatccactcaacatgcctagctttatcccaactgcaacctcacccaatggttgcacaagaattccatccttttctttaggtaagacacattggtgttacacacataatgtaattaatgccaactgcaaggatcatacttcatcgaaccaatatgtttccatggggattctcgttcaaaccgcgtcagggtatcccatgttcaaaaccctaaaaatccaatatctcagtgatggcctgaatcggaaaagctgctcaattgcaacagtccctgatggttgcgcaatgtactgttacgtttcaactcaacttgaaaccgacgactatgcggggtccagcccacctacccagaaacttaccctgttgttctataatgacaccatcaaagaaaggacaatatctccgtctggtcttgaaggaaattgggctactttggtgccaggagtggggagtggaatatatttcgaaaataagttgatctttcctgcatatgggggtgtcttgcccaatagtacactaggagttaaatcagcaagagaatttttccggcccgttaatccatataatccatgttcaggaccaccacaagagttagatcagcgtgctttgagatcatatttcccaagttacttctctagtcgaagggtacagagtgcatttctggtctgtgcctggaatcagatcctagttacaaattgcgagctagttgtcccctcaaacaatcagacacttatgggtgcagaaggaagagttttattgatcaataatcggctattatattatcagaggagtactagctggtggccgtatgaactcctctatgagatatcattcacatttacaaactctggtcaatcatctgtgaatatgtcctggatacctatatattcattcacccgtcctggtttgggcaaatgcagtggtgaaaatatatgcccaacagtctgtgtatcaggagtttatcttgatccctggccattaactccatacagccatcaatcaggcattaacagaaatttctatttcacaggtgcactgctaaattcaagcacaaccagggtgaatcctaccctttatgtctctgcccttaataatcttaaagtactagccccatatggtactcaaggattgtttgcgtcatacaccacaaccacctgctttcaagataccggtgacgctagtgtgtattgtgtctatattatggaactagcatcgaatattgttggagaattccaaattctacctgtgctagccagattgaccatcacttgagttgtagtgaatgtagtaggaagctttatgggcgtgtctcatttcttatcgattattaagaaaaaacaggcc

SEQ ID NO: 140 - DNA, 1809 bp, Nipah virus
atgccggcagaaaacaagaaagttagattcgaaaatactacttcagacaaagggaaaattcctagtaaagttattaagagctactacggaaccatggacattaagaaaataaatgaaggattattggacagcaaaatattaagtgctttcaacacagtaatagcattgcttggatctatcgtgatcatagtgatgaatataatgatcatccaaaattacacaagatcaacagacaatcaggccgtgatcaaagatgcgttgcagggtatccaacagcagatcaaagggcttgctgacaaaatcggcacagagatagggcccaaagtatcactgattgacacatccagtaccattactatcccagctaacattgggctgttaggttcaaagatcagccagtcgactgcaagtataaatgagaatgtgaatgaaaaatgcaaattcacactgcctcccttgaaaatccacgaatgtaacatttcttgtcctaacccactcccttttagagagtataggccacagacagaaggggtgagcaatctagtaggattacctaataatatttgcctgcaaaagacatctaatcagatattgaagccaaagctgatttcatacactttacccgtagtcggtcaaagtggtacctgtatcacagacccattgctggctatggacgagggctattttgcatatagccacctggaaagaatcggatcatgttcaagaggggtctccaaacaaagaataataggagttggagaggtactagacagaggtgatgaagttccttctttatttatgaccaatgtctggaccccaccaaatccaaacaccgtttaccactgtagtgctgtatacaacaatgaattctattatgtactttgtgcagtgtcaactgttggagaccctattctgaatagcacctactggtccggatctctaatgatgacccgtctagctgtgaaacccaagagtaatggtgggggttacaatcaacatcaacttgccctacgaagtatcgagaaagggaggtatgataaagttatgccgtatggaccttcaggcatcaaacagggtgacaccctgtattttcctgctgtaggatttttggtcaggacagagtttaaatacaatgattcaaattgtcccatcacgaagtgtcaatacagtaaacctgaaaattgcaggctatctatggggattagaccaaacagccattatatccttcgatctggactattaaaatacaatctatcagatggggagaaccccaaagttgtattcattgaaatatctgatcaaagattatctattggatctcctagcaaaatctatgattctttgggtcaacctgttttctaccaagcgtcattttcatgggatactatgattaaatttggagatgttctaacagtcaaccctctggttgtcaattggcgtaataacacggtaatatcaagacccgggcaatcacaatgccctagattcaatacatgtccagagatctgctgggaaggagtttataatgatgcattcctaattgacagaatcaattggataagcgcgggtgtattccttgacagcaatcagaccgcagaaaatcctgtttttactgtattcaaagataatgaaatactttatagggcacaactggcttctgaggacaccaatgcacaaaaaacaataactaattgttttctcttgaagaataagatttggtgcatatcattggttgagatatatgacacaggagacaatgtcataagacccaaactattcgcggttaagataccagagcaatgtacataa

SEQ ID NO: 141 - DNA, 1717 bp, Parainfluenza virus
atggaagattacagcaatctatctcttaaatcaattcctaaaaggacatgtagaatcattttccgaactgccacaattcttggaatatgcacattgattgttctatgttcaagtattcttcatgagataattcatcttgatgtttcctctggtctcatggattccgatgattcacagcaaggcattattcagcctattatagaatcattaaaatcattaattgctttggctaaccagattctgtacaatgttgcaataataattcctcttaaaattgacagtatcgagactgtaatattctctgctttaaaggatatgcatactgggagcatgtccaacaccaactgtacacccggaaatctgcttctgcatgatgcagcgtacatcaatggaataaacaaattccttgtacttaaatcatacaatgggacgcctaaatatggacctctcctaaatattcccagctttatcccctcagcaacatctcccaacgggtgcactagaataccatcattttcactcattaagacccattggtgttacactcacaatgtaatgcttggagattgcctcgatttcacgacatctaatcagtatttagcaatggggataatacaacaatctgctgcagcatttccaatcttcaggactatgaaaaccatttacctaagtgatggaatcaatcgcaaaagctgttcagtcactgctataccaggaggttgtgtcttgtattgctatgtagctacaagatctgagaaagaagattatgccacaactgatctagctgaactgagacttgctttctattattataatgatacctttattgaaagagtcatatctcttccaaatacaacagggcaatgggccacaatcaatcctgcagttggaagcgggatctatcatctaggctttatcttatttcctgtatatggtggtctcataagtgggactccttcctacaacaagcagtcctcacgctattttatcccaaaacatcccaacataacctgtgccggtaactccagcgaacaggctgcagcagcacggagttcctatgtaatccgttatcactcaaacaggttgattcagagtgctgttcttatttgcccattgtctgacatgcacacagcaaggtgtaatctagttatgtttaacaattctcaagtcatgatgggtgcagaaggtaggctctatgttattgacaataatttgtattattatcaacgtagttcctcttggtggtctgcatcgcttttttacaggatcaatacagatttttctaaaggaattcctcctatcattgaggctcaatgggtaccgtcctatcaagttccccgtcctggagtcatgccatgcaatgcaacaagtttttgccctgctaattgcatcacaggggtgtacgcagatgtgtggccgcttaacgatccagaacccacatcacaaaatgctctgaatcccaactatcgatttgctggagcctttctcagaaatgagtccaaccgaaccaatcccacattctacactgcatcagccagcgccctactaaatactaccggattcaacaacaccaatcacaaagcagcatatacgtcttcaacctgctttaagaatactggaactcaaaagatttattgtttgataataattgaaatgggctcatctcttttaggggagttccaaataataccatttctaagggaactaataccttaat

SEQ ID NO: 142 - DNA, 1729 bp, Parainfluenza virus
atggctgaaaaagggaaaacaaatagttcatattggtctacaacccgaaatgacaattccacggtaaacacacacattaatacaccagcaggaaggacacacatctggctactgattgcaacaacaatgcatacagtattgtccttcattatcatgatcctatgcattgacctaattataaaacaagacacttgtatgaagacaaacatcatgacagtatcctccatgaacgaaagtgccaaaataatcaaagagacaatcacagaattaatcagacaagaagtaatatcaaggaccataaacatacaaagttcagtacaaagcgggatcccaatattgttaaacaagcaaagcagagatctcacacaattaatagagaagtcatgcaacagacaggaattggctcagatatgcgaaaacaccattgctattcaccatgcagacggcatatctcctctggacccacacgatttctggagatgtcccgtaggggaacccctactgagcaacaaccccaatatctcattattacctggaccaagtctactttctggatccaccacaatttcaggatgtgttagactaccttcattatcaattggtgatgcaatatatgcgtattcatcaaacttaatcactcaaggatgtgcagatatagggaagtcatatcaggttttacaattaggttacatatccttaaattcagatatgtatcctgatttaaacccggtaatttctcatacctatgacatcaacgacaacaggaaatcatgttctgtaatagctgcaggaacaaggggttatcagttatgctccttgcccactgtgaatgagactacagactactcgagtgaaggtatagaagatttagtatttgacatattagatctcaagggaaagaccaaatctcatcgatacaaaaatgaagatataacttttgaccatcctttttctgcaatgtatccgagtgtaggaagtgggataaaaattgaaaatacactcattttcctagggtacggtggcttaacaactccgctccaaggcgacactaagtgtgtgataaacagatgtaccaatgttaatcagagtgtttgcaatgatgctcttaagataacttggctaaagaaaagacaagttgtcaatgtcttaattcgtatcaataattatttatctgataggccaaagattgttgtcgagacaattccaataactcaaaattacttaggtgccgaaggtaggctacttaaactaggtaaaaagatctacatatatactagatcttcaggttggcactccaacctgcaaataggatcattagatatcaacaaccccatgaccattaaatgggcgcctcatgaagtcctgtctcgaccaggaaaccaagactgcaactggtacaacagatgtccgagagaatgcatatcaggtgtatatactgatgcatatccactatctcctgatgcagtcaatgttgctacaaccacactgtacgcaaacacatcacgtgttaatcccaccataatgtactcaaatacctcagaaattatcaacatgctaagactcaagaatgtacaactagaggcagcatacactactacatcatgtatcactcatttcgggaagggctactgcttccacattgttgaaatcaaccaagccagccttaataccttacaacctatgttgttcaagacaagtatccctaaaatatgtaaaatcacatcttaag

SEQ ID NO: 143 - DNA, 981 bp, respiratory syncytial virus
ggggcaaatgcaaacatgtccaaaaacaagaatcaacgtactgccaggactctagaaaagacctgggatactcttaatcatctaattgtaatatcctcttgtttatacaaattaaatttaaaatctatagcacaaatagcactatcagttttggcaatgataatctcaacctctctcataattgcagccataatattcatcatctctgccaatcacaaagttacactaacaactgtcacagttcaaacaataaaaaaccacactgagaaaaacatcaccacttaccttactcaagtctcaccagaaagggttagcccatccaaacaacccacaaccacaccaccaatccacacaaactcagccacaatatcacccaatacaaaatcagaaacacaccatacaacagcacaaaccaaaggcagaaccaccactccaacacagaacaacaagccaagcacaaaaccacgtccaaaaaatccaccaaaaaaaccaaaagatgattaccattttgaagtgttcaacttcgttccctgtagtatatgtggcaacaatcaactctgcaaatccatttgcaaaacaataccaagcaataaaccaaagaaaaaaccaaccataaaacccacaaacaaaccacccaccaaaaccacaaacaaaagagactcaaaaacactagccaaaacactgaaaaaagaaaccaccatcaacccaacaaaaaaaccaacccccaagaccacagaaagagacaccagcaccctacaatccattgtgcttgacacaaccacatcaaaacacacagaaagagacaccagcacctcacaatccattgtgctagacacaaccacatcaaaacacacaatccaacagcaatccctccactcaaccacccccgaaaacacacccaactccacacaaacacccacagcatccgagccctccacatcaaattccaaccaaaaactctagtcatatgcttagttattc

SEQ ID NO: 144 - DNA, 1525 bp, Vaccinia virus
tctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggaaaggctagaaaaaaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgatattaagtattcacaaacgggaaagaaattaattattcataatccagagttagaagatagtggaagatacaactgttacgttcattacgacgacgttagaatcaagaatgatatcgtagtatcaagatgtaaaatacttacggttataccgtcgcaagaccacaggtttaaactaatactagatccaaaaatcaacgtaacgataggagaacctgccaatataacatgcactgctgtgtcaacgtcattattgattgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatacacaatgcatttttatatacattactgaataattattattattatttatatcgtatttgtgctatagaatgaatgaggatacgcg

SEQ ID NO: 145 - protein, 497 aa, Epstein Barr virus
MGSLEMVPMGAGPPSPGGDPDGYDGGNNSQYPSASGSSGNTPTPPNDEERESNEEPPPPYEDPYWGNGDRHSDYQPLGTQDQSLYLGLQHDGNDGLPPPPYSPRDDSSQHIYEEAGRGSMNPVCLPVIVAPYLFWLAAIAASCFTASVSTVVTATGLALSLLLLAAVASSYAAAQRKLLTPVTVLTAVVTFFAICLTWRIEDPPFNSLLFALLAAAGGLQGIYVLVMLVLLILAYRRRWRRLTVCGGIMFLACVLVLIVDAVLQLSPLLGAVTVVSMTLLLLAFVLWLSSPGGLGTLGAALLTLAAALALLASLILGTLNLTTMFLLMLLWTLVVLLICSSCSSCPLSKILLARLFLYALALLLLASALIAGGSILQTNFKSLSSTEFIPNLFCMLLLIVAGILFILAILTEWGSGNRTYGPVFMCLGGLLTMVAGAVWLTVMSNTLLSAWILTAGFLIFLIGFALFGVIRCCRYCCYYCLTLESEERPPTPYRNTV

SEQ ID NO: 146 - protein, 492 aa, Gadus callarias
MEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTAFRGALGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 147 - protein, 938 aa, Glutamate receptor
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTSTGGGRGALQNQKDTVLPRRAIEREEGQLQLCSRHRES

SEQ ID NO: 148 - protein, 399 aa, Hepatitis B virus
MGLSWTVPLEWGKNLSTSNPLGFLPDHQLDPAFRANTNNPDWDFNPKKDPWPEANKVGVGAYGPGFTPPHGGLLGWSPQSQGTLTTLPADPPPASTNRQSGRQPTPISPPLRDSHPQAMQWNSTAFHQALQNPKVRGLYFPAGGSSSGIVNPVPTIASHISSIFSRIGDPAPNMENITSGFLGPLLVLQAGFFLLTRILTIPQSLDSWWTSLNFLGGVPVCPGLNSQSPTSNHSPISCPPTCPGYRWMCLRRFIIFLFILLLCLIFLLVLLDYQGMLPVCPLIPGSSTTSTGPCKTCTTPAQGNSMYPSCCCTKPSDGNCTCIPIPSSWAFAKYLWEWASVRFSWLSLLVPFVQWFVGLSPTVWLSAIWMMWYWGPNLYNILSPFIPLLPIFFCLWVYI

SEQ ID NO: 149 - protein, 253 aa, prion
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 150 - DNA, 360 bp, Epstein Barr virus
ctatggggtccctagaaatggtgccaatgggcgcgggtccccctagccccggcggggatccggatgggtacgatggcggaaacaactcccaatatccatctgcttctggctcttctgggaacacccccaccccaccgaacgatgaggaacgtgaatctaatgaagagcccccaccgccttatgaggacccatattggggcaatggcgaccgtcactcggactatcaaccactaggaacccaagatcaaagtctgtacttgggattgcaacacgacgggaatgacgggctccctccccctccctactctccacgggatgactcatctcaacacatatacgaagaagcgggcagaggaaggt

SEQ ID NO: 151 - DNA, 215 bp, Epstein Barr virus
tatgaatccagtatgcctgcctgtaattgttgcgccctacctcttttggctggcggctattgccgcctcgtgtttcacggcctcagttagtaccgttgtgaccgccaccggcttggccctctcacttctactcttggcagcagtggccagctcatatgccgctgcacaaaggaaactgctgacaccggtgacagtgcttactgcggttgtcactt

SEQ ID NO: 152 - DNA, 99 bp, Epstein Barr virus
tctttgcaatttgcctaacatggaggattgaggacccaccttttaattctcttctgtttgcattgctggccgcagctggcggactacaaggcatttacg

SEQ ID NO: 153 - DNA, 249 bp, Epstein Barr virus
ttctggtgatgcttgtgctcctgatactagcgtacagaaggagatggcgccgtttgactgtttgtggcggcatcatgtttttggcatgtgtacttgtcctcatcgtcgacgctgttttgcagctgagtcccctccttggagctgtaactgtggtttccatgacgctgctgctactggctttcgtcctctggctctcttcgccagggggcctaggtactcttggtgcagcccttttaacattggcagcag

SEQ ID NO: 154 - DNA, 81 bp, Epstein Barr virus
ctctggcactgctagcgtcactgattttgggcacacttaacttgactacaatgttccttctcatgctcctatggacacttg

SEQ ID NO: 155 - DNA, 171 bp, Epstein Barr virus
tggttctcctgatttgctcttcgtgctcttcatgtccactgagcaagatccttctggcacgactgttcctatatgctctcgcactcttgttgctagcctccgcgctaatcgctggtggcagtattttgcaaacaaacttcaagagtttaagcagcactgaatttataccca

SEQ ID NO: 156 - DNA, 176 bp, Epstein Barr virus
atttgttctgcatgttattactgattgtcgctggcatactcttcattcttgctatcctgaccgaatggggcagtggaaatagaacatacggtccagtttttatgtgcctcggtggcctgctcaccatggtagccggcgctgtgtggctgacggtgatgtctaacacgcttttgtct

SEQ ID NO: 157 - DNA, 167 bp, Epstein Barr virus
gctttgccctctttggggtcattagatgctgccgctactgctgctactactgccttacactggaaagtgaggagcgcccaccgaccccatatcgcaacactgtataaaggtaagtattattaaattttagagacactatcacgtgtaacttgacgtgcaaggatgga

SEQ ID NO: 158 - DNA, 2856 bp, Glut-1
tagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggctgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcctttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgataagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatcgcattattttgaatgtgaagggaa

SEQ ID NO: 159 - DNA, 2878 bp, Glutamate receptor
gtacaaaaaagcagaagggccgtcaaggcccaccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgagcaccgggggtggacgcggcgctttgcaaaaccaaaaagacacagtgctgccgcgacgcgctattgagagggaggagggccagctgcagctgtgttcccgtcatagggagagctcaggcctcatgggcccagctttcttgtac

SEQ ID NO: 160 - DNA, 365 bp, Hepatitis B virus
atggggctttcttggacggtccctctcgagtggggaaagaacctttccaccagcaatcctctaggattccttcccgatcaccagttggacccagcattcagagcaaataccaacaatccagattgggacttcaatcccaaaaaggacccttggccagaggccaacaaggtaggagttggagcctatggacccgggttcacccctccacacggaggccttttggggtggagccctcagtctcagggcacactaacaactttgccagcagatccgcctcctgcctccaccaatcgtcagtcagggaggcagcctactcccatctctccaccactaagagacagtcatcctcaggccatgcagtggaa

SEQ ID NO: 161 - DNA, 2746 bp, prion
attaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccaaaaaaaaaaaaaaaa

SEQ ID NO: 162 - protein, 267 aa, Hepatitis A virus
SGGFSTTVSTEQNVPDPQVGITTMKDLKGKANKGKMDVSGVQAPVGAITTIEDPVLAKKVPETFPELKPGESRHTSDHMSIYKFMGRSHFLCTFTFNSNNKEYTFPITLSSTSNPPHGLPSTLRWFFNLFQLYRGPLDLTIIITGATDVDGMAWFTPVGLAVDTPRVEKESAPSIDYKTALGAVRFHSRRTGNIQIRLSWYSYLYAVSGALDGLGDKTDSTFGLVSIQIANYNHSDEYLSFSCYLSVTEQSEFYFPRAPLNSNALLS

SEQ ID NO: 163 - protein, 482 aa, Human Parvovirus
GGSNPVKSMWSEGATFSANSVTCTFSRQFLIPYDPEHHYKVFSPAASSCHNASGKEAKVCTISPIMGYSTPWRYLDFNALNLFFSPLEFQHLIENYGSIAPDALTVTISEIAVKDVTDKTGGGVQVTDSTTGRLCMLVDHEYQYPYVLGQGQDTLAPELPIWVYFPPQYAYLTVGDVNTQGISGDSKKLASEESAFYVLEHSSFQLLGTGGTATMSYKFPPVPPENLEGCSQHFYEMYNPLYGSRLGVPDTLGGDPKFRSLTHEDHAIQPQNFMPGPLVNSVSTKEGDSSNTGAGKALTGLSTGTSQNTRISLRPGPVSQPYHHWDTDKYVTGINASSHGQTTYGNAEDKEYQQGVGRFPNEKEQLKQLQGLNMHTYFPNKGTQQYTDQIERPLMVGSVWNRRALHYESQLWSKIPNLDDSFKTQFAALGGWGLHQPPPQIFLKILPQSGPIGGIKSMGITTLVQYAVGIMTVTMTFKLGPR

SEQ ID NO: 164 - protein, 541 aa, Norovirus
MKMASNDAAPSNDGAAGLVPEINTETLPLEPVAGAALAAAVTGQSNIIDPWIRTNFVQAPNGEFTVSPRNSPGEVLLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNRPSERMRLVAMLYTPLRSNGSGDDVFTVSCRVLTRPTPDFEFTYLVPPSVESKTKPFSLPILTISELTNSRFPAPIDSLFTAQNNNLNVQCQNGRCTLDGELQGTTQLLPTGICAFRGKISADVQNSHQDRWHMQLTNLNGTPFDPTDDVPAPLGTPDFTGLLFGVASQRNVGGTGNNTTRAHEVVIATTSTQFVPKLGSINFGSESEDFQVGPPTKFTPVGIKIETGHSFRQWDPPNYSGALTLNMNLAPPVAPNFPGEQLLFFRSNVPCAGGVSEGIIDCLLPQEWIQHFYQESAPSQSDVALIRYVNPDTGRTLFEAKLHRTGYITVAHSGDYPLVVPSNGYFRFDSWINQFYSLAPMGTGNGRRRVQ

SEQ ID NO: 165 - protein, 274 aa, Human rhinovirus
NPVEDYIDKVVDTVLQVPNTQPSGPQHSIQPSALGAMEIGASSTTIPGDLIETRYVINSNTNSEALIENFMGRSALWAKIQVANGFAKWDINFQEHAQVRKKFEMFTYARFDMEVTVVTNNTGLVQIMFVPPGIDAPDSIDSRLWDSASNPSVFYQPKSGFPRFTIPFTGLGSAYYMFYDGYDVPRNKSNAVYGITSTNDMGTLCFRAMEDTNEHSIRVFVKPKHTIAWIPRPPRATQYTHKFSTNYHVKKPDDTTGLLIQKHFINHRTDIKTA

SEQ ID NO: 166 - protein, 775 aa, Human rotavirus
MASLIYRQLLSNSYVTNISDEVNEIGTKKTTNVTVNPGPFAQTGYAPVDWGHGELPDSTLVQPTLDGPYQPTSLNLPVDYWMLIAPTREGKVAEGTNTTDRWFACVLVEPNVQNTQRQYVLDGQNVQLHVSNDSSTSWKFILFIKLTPYGTYTQYSTLSTPHKLCAWMKRDNRVYWYQGATPNASESYYLTINNDNSNVSSDAEFYLIPQSQTAMCTQYINNGLPPIQNTRNIVPVNITSRQIKDVRAQMNEDIVISKTSLWKEMQYNRDIIIRFKFANSIIKSGGLGYKWSEISFKPMNYQYTYTRDEEEVTAHTTCSVNGVNDFNYNGGTLPTDFAISRFEVIKENSYVYVDYWDDSQAFRNMVYVRSLAANLNDVVCSGGSYSFALPVGNHPVMSGGAVTLTSAGVTLSTQYTDYVSLNSLQFRFRLAVSEPSFSISRTRMSGIYGLPAVNPNNSAEYYEIAGRFSLISLVPTNDDYQTPIANSVTVRQDLERQLGELREEFNSLSQEIAVSQLIDLATLPLDMFSMFSGIKSTVEAVKSMTTNVMKRFKTSSLANAISDLTSNMSEAASSVRLTSVRSVGTITLPRARVSLQVGDDLRSMQDVSTQVSNVSRNLRLKEFTTQTDTLSFDDISAAVLKTKLDKSTQISQQTMPDIIAESSEKFIPKRSYRIVDEDIRFETGIDGTFYAYKVDTFNEIPFDMERFNKLITDSPVLSAIIDFKTLKNLNDNYGITKKQAMELLHSNPKTLKEFINNNNPIIRNRIENLISQCRL

SEQ ID NO: 167 - DNA, 800 bp, Hepatitis A virus
tctgggggtttttcaacaacagtttctacagagcagaatgttccagatccccaagttggtataacaaccatgaaggatttaaaaggcaaagctaataagggaaaaatggatgtttcaggagtgcaagcacctgtgggagctatcacaacaattgaggatcctgttttagcaaagaaagtacctgagacattccctgaattgaaacctggagagtccaggcatacatcagatcatatgtctatttacaagtttatgggaaggtctcattttttgtgcacttttacttttaattcaaacaataaagagtacacatttcctataaccttgtcttcaacctccaatcctcctcatggtttaccatcaacattgaggtggtttttcaatttgtttcaattgtatagaggacctttagatctgacaattatcatcactggagcaactgatgtagatggcatggcttggtttacaccagtaggtcttgccgttgatactcctcgggtagagaaggagtcagctccgtctattgactacaaaactgctcttggagctgtcagatttcactcaaggagaacagggaacattcagattaggttatcatggtattcttatttatatgctgtgtctggagcactggatggtttgggagataagacagattctacattcggattggtttctattcagattgcaaattataatcattctgatgaatatttgtcttttagttgctatttgtctgtcacagaacaatcagaattttattttcccagagctccattgaattcaaatgccttgttatc

SEQ ID NO: 168 - DNA, 1445 bp, Human Parvovirus
gggggcagtaatcctgttaaaagcatgtggagtgagggggccacttttagtgccaactctgtaacttgtacattttccagacagtttttaattccatatgacccagagcaccattataaggtattttctcccgcagcaagtagctgccacaatgccagtggaaaggaggcaaaggtttgcaccattagtcccataatggggtactcaaccccatggagatatttagattttaatgcattaaatttatttttttcacctttagagtttcagcacttaattgaaaattatggcagtatagctcctgatgctttaactgtaaccatatcagaaattgctgttaaggacgttacagacaaaactggagggggggtacaggttactgacagcactacagggcgcctatgcatgttagtggaccatgaatatcagtacccatatgtgttagggcaaggtcaggatactttagccccagaacttcctatttgggtatactttccccctcaatatgcttacttaacagtaggagatgttaacacacaaggaatttctggagacagcaaaaaattagcaagtgaagaatcagcattttatgttttggaacacagttcttttcagcttctaggtacaggaggtacagcaactatgtcttataagtttcctccagtgcccccagaaaatttagagggctgcagtcaacacttttatgaaatgtacaatcccttatacggatcccgcttaggggttcctgacacattaggaggtgacccaaaatttagatctttaacacatgaagaccatgcaattcagccccaaaacttcatgccagggccactagtaaactcagtgtctacaaaggagggagacagctctaatactggagctggaaaagccttaacaggccttagcacaggtacctctcaaaacactagaatatccctacgccctgggccagtgtctcagccataccaccactgggacacagataaatatgtcacaggaataaatgccagttctcatggtcagaccacttatggtaacgctgaagacaaagagtatcagcaaggagtgggtagatttccaaatgaaaaagagcagctaaaacagttacagggtttaaacatgcacacctactttcccaataaaggaacccagcaatatacagatcaaattgagcgacccctaatggtgggttctgtatggaacagaagagcccttcactatgaaagccagctgtggagtaaaattccaaatttagatgacagttttaaaactcagtttgcagccttaggaggatggggtttgcatcagccacctcctcaaatatttttaaaaatattaccacaaagtgggccaattggaggtattaaatcaatgggaattactaccttagttcagtatgctgtgggaattatgacagtaactatgacatttaaattggggccccg

SEQ ID NO: 169 - DNA, 2459 bp, Norovirus
gtgaatgaagatggcgtcgaatgacgccgctccatctaatgatggtgctgcgggcctcgtcccagagatcaacaccgagacccttcccctggaaccagtggctggtgcagctcttgctgcggctgtcactggtcaaagtaatataattgatccctggattagaacaaattttgtgcaagcacccaatggggagttcactgtttcacctaggaattccccaggagaagtcctcctaaatttagaattaggtcctgatttaaatccttatttggcacacttatctagaatgtataatgggtatgctggtggagtggaggtccaggttctcctagcagggaacgcgttcaccgctggaaagatcctcttcgctgccgtaccgccaaatttcccagttgaattcttaagtcctgcccaaatcactatgctcccacatttgatagttgacgtcaggacccttgagccaattatgatacccctccccgacgtgagaaacaccttcttccattacaataataggccctctgagcgtatgcgtttggtggccatgttgtacacacccctgagatccaacggttcaggtgatgatgtcttcacagtctcatgcagagtgctaactagacccactccagattttgaatttacctacctagttccaccctcagtagagtctaagacaaagcctttctctcttcccatcttaaccatttctgaattgactaattcaaggtttccagcacccattgattcattgtttactgcccaaaataacaatcttaatgtccaatgtcagaatggtcggtgcacactagatggtgagttgcagggaaccacccagctgctcccaactggaatatgtgccttcagagggaaaatatcagcagatgtgcaaaacagtcaccaagacaggtggcacatgcagttgacaaatctcaatggaaccccatttgacccaacagatgatgtcccagctccgcttggcacccctgacttcacaggtctactgtttggggttgcaagtcaaagaaacgttggtggaacaggtaacaacactaccagggcccacgaggtagtgatagcaacaactagcacacaatttgttccaaaattgggttctattaattttgggagtgaaagtgaagattttcaagtgggcccaccaaccaaattcacaccagttggaatcaaaattgaaaccgggcactctttcagacaatgggacccacctaactattctggagcactgaccctcaacatgaaccttgccccacctgttgccccaaatttcccaggtgagcagctgctcttctttagatcaaatgttccttgtgctggtggtgtcagtgagggtatcattgactgcctactgcctcaagagtggatacaacatttctaccaggaatccgctccatcccaatcagatgtggcactgatcagatatgtcaaccctgacacgggccgcactctctttgaggcaaaactccacaggactggttacattactgttgctcactctggtgactatcctcttgttgttccttccaatggctacttcagatttgattcttggataaatcaattttactcactcgcccccatgggaactgggaatgggcgcaggagagtgcagtaatggcaggagcttttatagcaggtcttgcaggtgacatgctcacctctgctgtaggctcactggcgaatgccggagcaaatgccataacacagaaaattgactttgaaaacaacaaacaactccaaacggcctcctttcaacatgacaaagatatgctccgcgcacaagtggatgcaaccaagcagctgcaggcagaaatgattgccatcaaacaggggatcttgaccgctggcggcttctcccctgctgacgcagcgagaggggctgtaggagcacccatgaccaaggtgcttgactggtctggcacacgctattgggcaccaaattctaccaaaacaacaagttactccgggcagttcacatcagcgcctgtgcacacaccaaatttcaacagcaaacccaggcctcctgccaaaacccagccttcttcttcttcttctggtagtgtttatagtctttcaacccaatcaacttcgctccctggaccctcttcttcgggttcatctgtttcttctgtctcaacacaatcaacaaaattgagttcagtttcttctatgagtagaacagcagattgggtcaatcaacaaaggagcctcagcccttacatgagcggggcccttaatatttctcatgtgacacctccatcaagcagggcttcaagttcgggaacagtgtcaactgtacccaaagaagttttggactcctggacatctgcattcaacacacgcagacagccgctcttcgcacacctcagagtgaggggggagtcacgtgtttagtgaaaagaatcaattagttttaattaggttaaattttaattggatctttt

SEQ ID NO: 170 - DNA, 810 bp, Human rhinovirus
tcaaaacccagttgaggactacatagacaaggtggtcgacactgtactacaggtcccaaacacccaacccagtggtccacaacacagtattcaaccaagtgctttgggcgctatggaaattggggcatcttcaaccaccataccaggtgatctcatagagactaggtatgtaatcaactcaaatactaacagtgaagccctaattgagaacttcatgggccgctcagctctttgggccaagatccaggtggcgaatggttttgcaaaatgggatataaacttccaagagcatgcacaagtcagaaagaaatttgaaatgtttacatatgctagatttgacatggaagttactgttgtcaccaacaacacaggtttggtacaaatcatgtttgtaccacctggtatagatgcaccagatagtattgactcccgtctatgggattctgcctccaacccgagtgttttctatcaaccaaaatcaggttttcctaggtttactattccattcactggattgggttcagcttattatatgttttatgatggttatgatgtccccagaaataaaagtaatgctgtgtatggtatcacatctacaaatgatatggggacactttgcttcagagctatggaagacaccaatgaacacagcattagagtctttgtaaagcctaaacataccatagcatggattccacgaccacctcgtgccacccaatacacccacaaattcagcacaaactaccatgttaagaaaccagatgacactactggactactaatacagaaacactttattaaccacaggac

SEQ ID NO: 171 - DNA, 2359 bp, Human rotavirus
ggctataaaatggcttctttaatttatagacagttattatcaaactcatatgttacaaacatctctgacgaagttaatgaaattggaactaaaaaaacaactaacgttactgttaatccagggccattcgcacaaacgggatatgcgcctgttgactggggacatggtgaattgcctgattctacattggtgcagccaactcttgatggtccataccaacccacctcactcaacttaccagttgattattggatgttaattgcgcctactagagaaggaaaagttgctgaaggtacaaatacgactgacagatggttcgcttgtgtactagttgaaccaaatgtgcaaaatacacaaagacaatacgtattagatgggcaaaatgtccaattgcatgtctcaaacgattcaagtacttcgtggaaatttatattattcattaaattgacgccttatggaacgtacactcaatattcaacattatcaacgccgcataagttgtgcgcgtggatgaaaagagataacagagtgtactggtatcaaggagcgacaccgaacgcatcagagagctattacttgaccataaacaatgataacagcaacgtttcaagtgacgctgaattttatttaataccgcaatcgcagaccgctatgtgtacacaatatataaacaatggtttaccaccaattcagaataccaggaatattgtaccagtaaatattacatctagacagattaaagacgtaagagctcagatgaatgaagacatagtaatatcaaaaacctcgttatggaaagaaatgcaatataatagagatataatcattagatttaaatttgctaattcaataatcaaatcaggtggactaggttataagtggtcggaaatatcatttaagcccatgaactatcaatatacgtatacgagagatgaagaagaagtaacagcacatacaacatgttcagtgaatggtgtcaatgattttaattataatggaggtacgttgcctactgattttgcaatatcgagatttgaggtcataaaggaaaattcttatgtatatgtagattattgggatgattcacaagcatttagaaatatggtatatgtgaggtcgttagctgcaaatttgaatgatgtagtatgcagtggaggttcttacagttttgcgttacctgtaggcaatcatccggtgatgagtggtggtgcagtgaccttaacatctgctggcgtaacactatcaacccagtatacagattatgtatcattaaattcattgcaattcagattcagattggcggtgagcgaaccatcattttccatctcgcgaactagaatgagtggcatatatggattaccagctgtaaatccaaataatagcgcagaatattatgagatagctggtagattctcactcatatcactagtaccaacaaatgatgactatcaaacgccaatcgctaattcagttaccgtaagacaagatttagagagacaattaggcgagttaagagaagaatttaattcgttgtcacaagaaatagctgtttcccaacttatagatctagcaacattaccgcttgatatgttctcaatgttctctggaataaaatcaacggtagaggcagtaaaatctatgactacgaatgtgatgaaaagatttaaaacatcaagtttagcaaacgccatatctgatttaacaagtaatatgtcggaagcggcatcatctgtaagattgacgtcagtgagatcggtgggcactattacattgccaagagctagggtttcattgcaagtgggcgatgacttgaggtccatgcaagacgtatcaacacaagtgtcaaatgtgagtagaaatttaagattgaaagagttcacgacgcaaactgatactttaagctttgatgacatctctgcagctgtattgaagacgaaactagataaatcgacgcaaatttcacaacaaacaatgccagatattatagctgagtcatctgagaagtttataccgaagagatcgtatagaatagttgatgaggatattcgattcgaaactggaattgacggaacgttttatgcttacaaagtcgatacatttaatgaaattccgtttgatatggaacgatttaataaattaataacagattcaccagttttatcagcaataatagactttaagacgttaaagaacttaaacgacaattatggaataacaaagaaacaagccatggaactattacattcaaatccaaagacattaaaagagtttataaataataataatccaataattagaaatagaatcgaaaacttaatatcgcagtgtaggttgtagctgtctattttaagatgtgacc

SEQ ID NO: 172-184 - skipped (13 entries)

SEQ ID NO: 185 - protein, 566 aa, Influenza virus HA
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVLHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYIKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 186 - protein, 662 aa, canine distemper virus
MHKGIPKSSKTQTHTQQDRPPQPSTELEETRTSRARHSTTSAQRSTHYDPRTSDRPVSYTMNRTRSRKQTSHRLKNIPVHGNHEATIQHIPESVSKGARSQIERRQPNAINSGSQCTWLVLWCLGMASLFLCSKAQIHWNNLSTIGIIGTDSVHYKIMTRPSHQYLVIKLMPNVSLIENCTKAELGEYEKLLNSVLEPINQALTLMTKNVKPLQSLGSGRRQRRFAGVVLAGVALGVATAAQITAGIALHQSNLNAQAIQSLRTSLEQSNKAIEEIREATQETVIAVQGVQDYVNNELVPAMQHMSCELVGQRLGLRLLRYYTELLSIFGPSLRDPISAEISIQALIYALGGEIHKILEKLGYSGSDMIAILESRGIKTKITHVDLPGKFIILSISYPTLSEVKGVIVHRLEAVSYNIGSQEWYTTVPRYIATNGYLISNFDESSCVFVSESAICSQNSLYPMSPLLQQCIRGDTSSCARTLVSGTMGNKFILSKGNIVANCASILCKCYSTSTIINQSPDKLLTFIASDTCPLVEIDGATIQVGGRQYPDMVYEGKVALGPAISLDRLDVGTNLGNALKKLDDAKVLIDSSNQILETVRRSSFNFGSLLSVPILSCTALALLLLIYCCKRRYQQTLKQHTKVDPAFKPDLTGTSKSYVRSL

SEQ ID NO: 187 - protein, 907 aa, Cytomegalovirus
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 188 - protein, 742 aa, Cytomegalovirus
MRPGLPSYLIILAVCLFSHLLSSRYGAEAVSEPLDKAFHLLLNTYGRPIRFLRENTTQCTYNSSLRNSTVVRENAISFNFFQSYNQYYVFHMPRCLFAGPLAEQFLNQVDLTETLERYQQRLNTYALVSKDLASYRSFSQQLKAQDSLGEQPTTVPPPIDLSIPHVWMPPQTTPHGWTESHTTSGLHRPHFNQTCILFDGHDLLFSTVTPCLHQGFYLIDELRYVKITLTEDFFVVTVSIDDDTPMLLIFGHLPRVLFKAPYQRDNFILRQTEKHELLVLVKKDQLNRHSYLKDPDFLDAALDFNYLDLSALLRNSFHRYAVDVLKSGRCQMLDRRTVEMAFAYALALFAAARQEEAGAQVSVPRALDRQAALLQIQEFMITCLSQTPPRTTLLLYPTAVDLAKRALWTPNQITDITSLVRLVYILSKQNQQHLIPQWALRQIADFALKLHKTHLASFLSAFARQELYLMGSLVHSMLVHTTERREIFIVETGLCSLAELSHFTQLLAHPHHEYLSDLYTPCSSSGRRDHSLERLTRLFPDATVPATVPAALSILSTMQPSTLETFPDLFCLPLGESFSALTVSEHVSYIVTNQYLIKGISYPVSTTVVGQSLIITQTDSQTKCELTRNMHTTHSITVALNISLENCAFCQSALLEYDDTQGVINIMYMHDSDDVLFALDPYNEVVVSSPRTHYLMLLKNGTVLEVTDVVVDATDSRLLMMSVYALSAIIGIYLLYRMLKTC

SEQ ID NO: 189 - protein, 676 aa, Ebola virus
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVSNGAKNISGQSPARTSSDPGTNTTTEDHKIMASENSSAMVQVHSQGREAAVSHLTTLATISTSPQSLTTKPGPDNSTHNTPVYKLDISEATQVEQHHRRTDNDSTASDTPSATTAAGPPKAENTNTSKSTDFLDPATTTSPQNHSETAGNNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQWIPAGIGVTGVIIAVIALFCICKFVF

SEQ ID NO: 190 - protein, 852 aa, Human immunodeficiency virus
MRVKEIRRNYQHLWRWGTMLLGILMICSAAEKLWVTVYYGVPVWKEANTTLFCASDAKATKAEVHNVWATHACVPTDPNPQELALENVTEKFDMWKNNMVEQMHEDIISLWDQSLKPCVKLTPLCVTLTCTDYSGNNNTNITGKANTTIDDIEMKNCSFNITTGIRDKVKREYALFYKVDVVPIEKNTSYRLIHCNTSTITQACPKVSFEPIPIHYCAPAGFAILKCKDKKFNGTGLCTNVSTVQCTHGIRPVVSTQLLLNGSLAEEEVVIRSQNFTDNVKTIIVQLNESVVINCTRPNNNTRKSIHIGPGGAFYTTGQVIGNIRQAYCNISEEQWNKTLKYIVEKLREQFGNKTIIFNQSSGGDPEIVTHSFNCGGEFFYCNTSRLFNSTWNITEGSNSTAGSNKNITLPCRIKQIINMWQEVGKAMYAPPISGLIRCTSNITGLLLTRDGGHDNKTNDTEIFRPGGGNMRDNWRSELYKYKVVKIEPLGIAPTKARRRVVQRDKRAVGIGAMFLGILGAAGSTMGAASITLTVQARQLLSGIVQQQNNLLRAIEAQQHLLQLTVWGIKQLQARVLAVERYLKDQQLLGIWGCSGKLICTTNVPWNTSWSNRSLDYIWGNMTWIQWEREIDNYTDLIYTLIEESQDQQEKNELELMKLDKWDSLWSWFSITNWLWYIRLFIIIVGGLVGLRIVFTVLSIVNRVRQGYSPLSFQTRLQAPRGPDRPEGIEEEGGDRDRDRSVRLVDGFLALLWEDLRSLFLFSYRHLRDLLLIVARTVELLGRRGREALKYGWNLLLYWSQELKNSAVSLLNATAITVAEGTDRAIELIQRAFRAFLRIPTRIRQGLERALL

SEQ ID NO: 191 - protein, 838 aa, herpes simplex virus
MGNGLWFVGVIILGAAWGQVHDWTEQTDPWFLDGLGMDRMYWRDTNTGRLWLPNTPDPQKPPRGFLAPPDELNLTTASLPLLRWYEERFCFVLVTTAEFPRDPGQLLYIPKTYLLGRPPNASLPAPTTVEPTAQPPPAVAPLKGLLHNPTASVLLRSRAWVTFSAVPDPEALTFPRGDNVATASHPSGPRDTPPPRPPVGARRHPTTELDITHLHNASTTWLATRGLLRSPGRYVYFSPSASTWPVGIWTTGELVLGCDAALVRARYGREFMGLVISMHDSPPAEVMVVPAGQTLDRVGDPADENPPGALPGPPGGPRYRVFVLGSLTRADNGSALDALRRVGGYPEEGTNYAQFLSRAYAEFFSGDAGAEQGPRPPLFWRLTGLLATSGFAFVNAAHANGAVCLSDLLGFLAHSRALAGLAARGAAGCAADSVFFNVSVLDPTARLQLEARLQHLVAEILEREQSLALHALGYQLAFVLDSPSAYDAVAPSAAHLIDALYAEFLGGRVVTTPVVHRALFYASAVLRQPFLAGVPSAVQRERARRSLLIASALCTSDVAAATNADLRTALARADHQKTLFWLPDHFSPCAASLRFDLDESVFILDALAQATRSETPVEVLAQQTHGLASTLTRWAHYNALIRAFVPEASHRCGGQSANVEPRILVPITHNASYVVTHSPLPRGIGYKLTGVDVRRPLFLTYLTATCEGSTRDIESKRLVRTQNQRDLGLVGAVFMRYTPAGEVMSVLLVDTDNTQQQIAAGPTEGAPSVFSSDVPSTALLLFPNGTVIHLLAFDTQPVAAIAPGFLAASALGVVMITAALAGILKVLRTSVPFFWRRE

SEQ ID NO: 192 - protein, 224 aa, herpes simplex virus
MGILGWVGLIAVGILCVRGGLPSTEYVIRSRVAREVGDILKVPCVPLPSDDLDWRYETPSAINYALIDGIFLRYHCPGLDTVLWDRHAQRAYWVNPFLFGAGFLEDLSHPAFPADTQETETRLALYKEIRQALDSRKQAASHTPVKAGCVNFDYSRTRRCVGRQDLGLTNRTSGRTPVLPSDDEAGLQPKPLTTPSPIIATSDPTPRRDAATKSRRRRPHFRGL

SEQ ID NO: 193 - protein, 576 aa, Influenza virus HA
MKAIPLVLLYTFTAANADTLCIGYHANNSTDTVDTVLEKNVTVTHSVNLLEDRHNGKLCKLGGIAPLHLGKCNIAGWLLGNPECESLSTISSWSYIVETSNSDNGTCYPGDFINYEELREQLSSVSSFERFEIFPKASSWPNHETNGGVTTACPYAGAKSFYRNLIWLVKKGNSYPKLSKSYVNNKGKEVLVLWGIHHPPTSNDQQALYQNADAYVFVGSSKYNKMFKPEIATRPKVRNQTGRMNYYWTLVEPGDTITFEATGNLVVPRYAFAMNRGSESGIIISDTPVHDCNTTCQTPKGAINTSLPFQNVHPATIGECPKYVKSTKLRMATGLRNIPSIQSRGLFGAIAGFIEGGWTGMIDGWYGYHHQNGQGSGYAADQKSTQNAIDGITNKVNSVIEKMNTQFTAVGKEFNHLEKRIENLNKKVDDGFLDVWTYNAELLVLLENERTLDFHDSNVKNLYEKVRSQLRNNAKEIGNGCFEFYHKCDDTCMESVKNGTYDYSKYSEESKLNREVIDGVKLDSTRIYQILAIYSTVASSLVLLVSLGAISFWMCSNGSLQCRICIDFRDMRKNTL

SEQ ID NO: 194 - protein, 580 aa, Influenza virus HA
LSTHGSTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPKLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 195 - protein, 565 aa, Influenza virus HA
  misc_feature (144)..(144): Xaa can be any naturally occurring amino acid
  misc_feature (202)..(202): Xaa can be any naturally occurring amino acid
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHXVTGVSASCSHNGKSSFYRNLLWLTGKNGLYPNLSKSYANNKEKEVLVLWGVHHPPNIXDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 196 - protein, 566 aa, Influenza virus HA
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNKSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 197 - protein, 568 aa, Influenza virus HA
MEKIVLLLAIVSLVKSDQICIGYHANNSTEQVDTIMEKNVTVTHAQDILEKTHNGKLCDLNGVKPLILRDCSVAGWLLGNPMCDEFINVPEWSYIVEKASPANDLCYPGDFNDYEELKHLLSRTNHFEKIQIIPKSSWSNHDASSGVSSACPYHGRSSFFRNVVWLIKKNSAYPTIKRSYNNTNQEDLLVLWGIHHPNDAAEQTKLYQNPTTYISVGTSTLNQRLVPEIATRPKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNTPQRERRRKKRGLFGAIAGFIEGGWQGMVDGWYGYHHSNEQGSGYAADKESTQKAIDGVTNKVNSIIDKMNTQFEAVGREFNNLERRIENLNKQMEDGFLDVWTYNAELLVLMENERTLDFHDSNVKNLYDKVRLQLRDNAKELGNGCFEFYHKCDNECMESVKNGTYDYPQYSEEARLNREEISGVKLESMGTYQILSIYSTVASSLALAIMVAGLSLWMCSNGSLQCRICI

SEQ ID NO: 198 - protein, 349 aa, Influenza virus HA
ACVLVEAKGDKICLGHHAVVNGTKVNTLTEKGIEVVNATETVETANIGKICTQGKRPTDLGQCGLLGTLIGPPQCDQFLEFESDLIIERREGNDVCYPGKFTNEESLRQILRGSGGIDKESMGFTYSGIITNGATSACRRSGSSFYAEMKWLLSNSDNAAFPQMTKSYRNPRNKPALIVWGIHHSGSTTEQTKLYGSGNKLITVESSKYQQSFTPSPGARPQVNGESGRIDFHWMLLDPNDTVTFTFNGAFIAPDRASFFKGESLGVQSDVPLDSSCGGDCFHSGGTIVSSLPFQNINPRTVGKCPRYVKQPSLLLATGMRNVPENPKTRGLFGAIAGFIEKDGGSHYG

SEQ ID NO: 199 - protein, 560 aa, Influenza virus HA
METISLITILLVVTASNADKICIGHQSTNSTETVDTLTETNVPVTHAKELLHTEHNGMLCATSLGHPLILDTCTIEGLVYGNPSCDLLLGGREWSYIVERSSAVNGTCYPGNVENLEELRTLFSSASSYQRIQIFPDTTWNVTYTGTSRACSGSFYRSMRWLTQKSGFYPVQDAQYTNNRGKSILFVWGIHHPPTYTEQTNLYIRNDTTTSVTTEDLNRTFKPVIGPRPLVNGLQGRIDYYWSVLKPGQTLRVRSNGNLIAPWYGHVLSGGSHGRILKTDLKGGNCVVQCQTEKGGLNSTLPFHNISKYAFGTCPKYVRVNSLKLAVGLRNVPARSSRGLFGAIAGFIEGGWPGLVAGWYGFQHSNDQGVGMAADRDSTQKAIDKITSKVNNIVDKMNKQYEIIDHEFSEVETRLNMINNKIDDQIQDVWAYNAELLVLLENQKTLDEHDANVNNLYNKVKRALGSNAMEDGKGCFELYHKCDDQCMETIRNGTYNRRKYREESRLERQKIEGVKLESEGTYKILTIYSTVASSLVLAMGFAAFLFWAMSNGSCRCNICI

SEQ ID NO: 200 - protein, 546 aa, Nipah virus
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 201 - protein, 574 aa, respiratory syncytial virus
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 202 - protein, 574 aa, respiratory syncytial virus
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 203 - protein, 1255 aa, SARS virus
MFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCSFGGVSVITPGTNASSEVAVLYQDVNCTDVSTAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKEELDKYFKNHTSPDVDLGDISGINASVVNIQKEIDRLNEVAKNLNESLIDLQELGKYEQYIKWPWYVWLGFIAGLIAIVMVTILLCCMTSCCSCLKGACSCGSCCKFDEDDSEPVLKGVKLHYT

SEQ ID NO: 204 - skipped

SEQ ID NO: 205 - protein, 867 aa, Varicella zoster
MFVTAVVSVSPSSFYESLQVEPTQSEDITRSAHLGDGDEIREAIHKSQDAETKPTFYVCPPTGSTIVRLEPTRTCPDYHLGKNFTEGIAVVYKENIAAYKFKATVYYKDVIVSTAWAGSSYTQITNRYADRVPIPVSEITDTIDKFGKCSSKATYVRNNHKVEAFNEDKNPQDMPLIASKYNSVGSKAWHTTNDTYMVAGTPGTYRTGTSVNCIIEEVEARSIFPYDSFGLSTGDIIYMSPFFGLRDGAYREHSNYAMDRFHQFEGYRQRDLDTRALLEPAARNFLVTPHLTVGWNWKPKRTEVCSLVKWREVEDVVRDEYAHNFRFTMKTLSTTFISETNEFNLNQIHLSQCVKEEARAIINRIYTTRYNSSHVRTGDIQTYLARGGFVVVFQPLLSNSLARLYLQELVRENTNHSPQKHPTRNTRSRRSVPVELRANRTITTTSSVEFAMLQFTYDHIQEHVNEMLARISSSWCQLQNRERALWSGLFPINPSALASTILDQRVKARILGDVISVSNCPELGSDTRIILQNSMRVSGSTTRCYSRPLISIVSLNGSGTVEGQLGTDNELIMSRDLLEPCVANHKRYFLFGHHYVYYEDYRYVREIAVHDVGMISTYVDLNLTLLKDREFMPLQVYTRDELRDTGLLDYSEIQRRNQMHSLRFYDIDKVVQYDSGTAIMQGMAQFFQGLGTAGQAVGHVVLGATGALLSTVHGFTTFLSNPFGALAVGLLVLAGLVAAFFAYRYVLKLKTSPMKALYPLTTKGLKQLPEGMDPFAEKPNATDTPIEEIGDSQNTEPSVNSGFDPDKFREAQEMIKYMTLVSAAERQESKARKKNKTSALLTSRLTGLALRNRRGYSRVRTENVTGV

SEQ ID NO: 206 - protein, 661 aa, Varicella zoster
MFYEALKAELVYTRAVHGFRPRANCVVLSDYIPRVACNMGTVNKPVVGVLMGFGIITGTLRITNPVRASVLRYDDFHTDEDKLDTNSVYEPYYHSDHAESSWVNRGESSRKAYDHNSPYIWPRNDYDGFLENAHEHHGVYNQGRGIDSGERLMQPTQMSAQEDLGDDTGIHVIPTLNGDDRHKIVNVDQRQYGDVFKGDLNPKPQGQRLIEVSVEENHPFTLRAPIQRIYGVRYTETWSFLPSLTCTGDAAPAIQHICLKHTTCFQDVVVDVDCAENTKEDQLAEISYRFQGKKEADQPWIVVNTSTLFDELELDPPEIEPGVLKVLRTEKQYLGVYIWNMRGSDGTSTYATFLVTWKGDEKTRNPTPAVTPQPRGAEFHMWNYHSHVFSVGDTFSLAMHLQYKIHEAPFDLLLEWLYVPIDPTCQPMRLYSTCLYHPNAPQCLSHMNSGCTFTSPHLAQRVASTVYQNCEHADNYTAYCLGISHMEPSFGLILHDGGTTLKFVDTPESLSGLYVFVVYFNGHVEAVAYTVVSTVDHFVNAIEERGFPPTAGQPPATTKPKEITPVNPGTSPLLRYAAWTGGLAAVVLLCLVIFLICTAKRMRVKAYRVDKSPYNQSMYYAGLPVDDFEDSESTDTEEEFGNAIGGSHGGSSYTVYIDKTR

SEQ ID NO: 207 - protein, 354 aa, Varicella zoster
MFLIHCLISAVIFYIQVTNALIFKGDHVSLQVNSSLTSILIPMQNDNYTEIKGQLVFIGEQLPTGTNYSGTLELLYADTVAFCFRSVQVIRYDGCPRIRTSAFISCRYKHSWHYGNSTDRISTEPDAGVMLKITKPGINDAGVYVLLVRLDHSRSTDGFILGVNVYTAGSHHNIHGVIYTSPSLQNGYSTRALFQQARLCDLPATPKGSGTSLFQHMLDLRAGKSLEDNPWLHEDVVTTETKSVVKEGIENHVYPTDMSTLPEKSLNDPPENLLIIIPIVASVMILTAMVIVIVISVKRRRIKKHPIYRPNTKTRRGIQNATPESDVMLEAAIAQLATIREESPPHSVVNPFVK

SEQ ID NO: 208 - DNA, 1701 bp, Influenza virus HA
atgaagactatcattgctttgagctacattctatgtctggttttcgctcaaaaacttcccggaaatgacaacagcacggcaacgctgtgccttgggcaccatgcagtaccaaacggaacgatagtgaaaacaatcacgaatgaccaaattgaagttactaatgctactgagctggttcagagttcctcaacaggtggaatatgcgacagtcctcatcagatccttgatggagaaaactgcacactaatagatgctctattgggagaccctcagtgtgatggcttccaaaataagaaatgggacctttttgttgaacgcagcaaagcctacagcaactgttacccttatgatgtgccggattatgcctcccttaggtcactagttgcctcatccggcacactggagtttaacaatgaaagcttcaattggactggagtcactcagaatggaacaagctctgcttgcaaaaggagatctaataaaagtttctttagtagattgaattggttgacccatttaaaatacaaatacccagcattgaacgtgactatgccaaacaatgaaaaatttgacaaattgtacatttggggggttctccacccgggtacggacagtgaccaaatcagcctatatgctcaagcatcaggaagaatcacagtctctaccaaaagaagccaacaaactgtaatcccgaatatcggatctagacccagggtaagggatgtctccagcagaataagcatctattggacaatagtaaaaccgggagacatacttttgattaacagcacagggaatctaattgctcctaggggttacttcaaaatacgaagtgggaaaagctcaataatgagatcagatgcacccattggcaaatgcaattctgaatgcatcactccaaatggaagcattcccaatgacaaaccatttcaaaatgtaaacaggatcacatatggggcctgtcccagatatattaagcaaaacactctgaaattggcaacagggatgcgaaatgtaccagagaaacaaactagaggcatatttggcgcaatcgcgggtttcatagaaaatggttgggagggaatggtggacggttggtacggtttcaggcatcaaaattctgagggcacaggacaagcagcagatctcaaaagcactcaagcagcaatcaaccaaatcaatgggaaactgaataggttaatcgggaaaacaaacgagaaattccatcagattgaaaaagaattctcagaagtagaagggagaattcaggacctcgagaaatatgttgaggacactaaaatagatctctggtcatacaacgcggagcttcttgttgccctggagaaccaacatacaattgatctaactgactcagaaatgaacaaactgtttgaaagaacaaagaagcaactgagggaaaatgctgaggatatgggcaatggttgtttcaaaatataccacaaatgtgacaatgcctgcatagggtcaatcagaaatggaacttatgaccatgatgtatacagagatgaagcattaaacaaccggttccagatcaaaggtgttgagctgaagtcaggatacaaagattggatcctatggatttcctttgccatatcatgttttttgctttgtgttgctttgttggggttcatcatgtgggcctgccaaaaaggcaacattaggtgcaacatttgcatttga

SEQ ID NO: 209 - DNA, 2240 bp, Cytomegalovirus
caatcagcatgtcttgagcatgcggtagagcagatagatgccgatgatggccgatagcgcgtagacggacatcatgaggagacgactgtcggtggcgtccacgacgacgtcagttacttctagtaccgtaccgtttttcaaaagcatgaggtagtgagttcgcggagatgagaccaccacttcgttgtagggatccagggcgaaaaggacgtcgtccgagtcgtgcatgtacatgatgttgatgacgccttgcgtgtcgtcgtattctagcagggcgctttggcaaaaggcgcagttttctagcgaaatgttgagcgccactgtgatgctgtgtgtggtatgcatgttgcgcgtcagttcgcatttagtttgactgtccgtctgggtgatgatgaggctctggcctacgacggtggtggagacagggtaggagatacctttgatcaggtactggtttgttacgatataactgacgtgttcggagacggtcagcgcggagaaggattcgccgagcggcaagcaaaacaggtcggggaaggtttccagcgtgcttggttgcatggtagataggatggagagggcggcgggaacggtagcggggacggtggcatcggggaagagacgcgtgaggcgttcgagcgagtgatcgcgtcgcccgctactggaacagggtgtgtacaggtcgctgaggtattcgtggtgtggatgagctaacaactgcgtaaagtgtgatagctcggccaatgaacagaggcccgtttctacgatgaagatttcgcgtctctccgtcgtatgtaccagcatggagtggacgaggctgcccatgaggtagagttcttggcgtgcgaaggctgaaagaaaagaggccaggtgcgttttgtgtagttttagggcaaagtcggcgatctgtcgtagtgcccattgggggatgagatgttgctgattctgtttagagagtatgtagaccaggcgtacgaggctggtgatgtcggtgatctgattcggtgtccaaagggctcgtttggccaggtccacggccgtgggatacagcagcaacgtggtgcgtggtggtgtttgtgagaggcaggtgatcataaattcttgtatttgtaagagtgcggcctggcggtctagggcccgtgggacggagacttgggcgccggcctcttcttgtcgggctgctgcgaacagtgctaatgcgtaggcgaaggccatttctaccgtgcggcggtccagcatctgacatcgaccgctcttgagtacatccacggcgtaacggtgaaagctgttacgtagtagtgcgctgaggtctaggtagttgaagtcaagtgcggcgtcaagaaagtccgggtctttgagataagagtgacggttcagttgatctttcttaactagcaccaggagctcgtgtttttcagtttgtcgtagtataaagttgtcgcgttgatagggcgctttgaaaagtacgcgtggaagatggccgaagataagcagcatgggtgtgtcgtcgtctatggacaccgtaactacgaagaagtcctcggtcagtgttattttaacgtaacgtagttcgtcgatgaggtaaaagccttggtgcaaacaaggtgtgacggtgctgaatagtagatcgtgtccatcaaagaggatacaggtctggttaaagtgtggtcggtgtagtcctgaggtggtatgtgattctgtccagccgtgtggagtggtttgcggtggcatccaaacgtgaggtattgacaggtcaatgggcggtggcacagtggtgggctgttcacctaggctgtcttgtgcctttagctgctgcgaaaaagatcggtagctggccaggtctttggataccagcgcgtaagtgttaagtctctgttggtatctttccagggtttcggtcagatctacctggttcagaaactgctccgccagaggacccgcaaaaagacatcgaggcatatggaatacatagtattgattatagctttggaaaaagttgaaactgatggcgttttccctgacgaccgtgctgttacggaggctgctgttgtaggtacactgggtggtattttcacgcaggaagcggatgggtctcccgtaggtgttgagcagtaggtgaaacgctttgtccagcggttcggatacggcttctgcgccatatcgtgacgaaagtaggtggctgaagagacagacggcgaggatgatgaggtaggaggggaggcctggccgcatagcgcggc

SEQ ID NO: 210 - DNA, 2506 bp, Ebola virus
gatgaagattaagccgacagtgagcgtaatcttcatctctcttagattatttgttttccagagtaggggtcgtcaggtccttttcaatcgtgtaaccaaaataaactccactagaaggatattgtggggcaacaacacaatgggcgttacaggaatattgcagttacctcgtgatcgattcaagaggacatcattctttctttgggtaattatccttttccaaagaacattttccatcccacttggagtcatccacaatagcacattacaggttagtgatgtcgacaaactagtttgtcgtgacaaactgtcatccacaaatcaattgagatcagttggactgaatctcgaagggaatggagtggcaactgacgtgccatctgcaactaaaagatggggcttcaggtccggtgtcccaccaaaggtggtcaattatgaagctggtgaatgggctgaaaactgctacaatcttgaaatcaaaaaacctgacgggagtgagtgtctaccagcagcgccagacgggattcggggcttcccccggtgccggtatgtgcacaaagtatcaggaacgggaccgtgtgccggagactttgccttccataaagagggtgctttcttcctgtatgatcgacttgcttccacagttatctaccgaggaacgactttcgctgaaggtgtcgttgcatttctgatactgccccaagctaagaaggacttcttcagctcacaccccttgagagagccggtcaatgcaacggaggacccgtctagtggctactattctaccacaattagatatcaggctaccggttttggaaccaatgagacagagtacttgttcgaggttgacaatttgacctacgtccaacttgaatcaagattcacaccacagtttctgctccagctgaatgagacaatatatacaagtgggaaaaggagcaataccacgggaaaactaatttggaaggtcaaccccgaaattgatacaacaatcggggagtgggccttctgggaaactaaaaaaacctcactagaaaaattcgcagtgaagagttgtctttcacagttgtatcaaacggagccaaaaacatcagtggtcagagtccggcgcgaacttcttccgacccagggaccaacacaacaactgaagaccacaaaatcatggcttcagaaaattcctctgcaatggttcaagtgcacagtcaaggaagggaagctgcagtgtcgcatctaacaacccttgccacaatctccacgagtccccaatccctcacaaccaaaccaggtccggacaacagcacccataatacacccgtgtataaacttgacatctctgaggcaactcaagttgaacaacatcaccgcagaacagacaacgacagcacagcctccgacactccctctgccacgaccgcagccggacccccaaaagcagagaacaccaacacgagcaagagcactgacttcctggaccccgccaccacaacaagtccccaaaaccacagcgagaccgctggcaacaacaacactcatcaccaagataccggagaagagagtgccagcagcgggaagctaggcttaattaccaatactattgctggagtcgcaggactgatcacaggcgggagaagaactcgaagagaagcaattgtcaatgctcaacccaaatgcaaccctaatttacattactggactactcaggatgaaggtgctgcaatcggactggcctggataccatatttcgggccagcagccgagggaatttacatagaggggctaatgcacaatcaagatggtttaatctgtgggttgagacagctggccaacgagacgactcaagctcttcaactgttcctgagagccacaactgagctacgcaccttttcaatcctcaaccgtaaggcaattgatttcttgctgcagcgatggggcggcacatgccacattctgggaccggactgctgtatcgaaccacatgattggaccaagaacataacagacaaaattgatcagattattcatgattttgttgataaaacccttccggaccagggggacaatgacaattggtggacaggatggagacaatggataccggcaggtattggagttacaggcgttataattgcagttatcgctttattctgtatatgcaaatttgtcttttagtttttcttcagattgcttcatggaaaagctcagcctcaaatcaatgaaaccaggatttaattatatggattacttgaatctaagattacttgacaaatgataatataatacactggagctttaaacatagccaatgtgattctaactcctttaaactcacagttaatcataaacaaggtttgacatcaatctagttatctctttgagaatgataaacttgatgaagattaagaaaaaggtaatctttcgattatctttaatcttcatccttgattctacaatcatgacagttgtctttagtgacaagggaaagaagcctttttattaagttgtaata

SEQ ID NO: 211 - DNA, 2470 bp, Human immunodeficiency virus
tgtgggtcacagtctattatggggtaccagtgtggaaagaagcaaacaccactctattttgtgcatcagatgctaaagcaactaaggcagaggtacataatgtttgggctacacatgcctgtgtacccacggaccccaacccacaagaactagcattggaaaatgtgacagaaaagtttgacatgtggaaaaataacatggtagaacagatgcatgaggatataatcagtttatgggatcaaagcctaaagccatgtgtaaaattaaccccactctgtgttaccttaacttgtactgattattcggggaataataatactaatatcactgggaaggctaataccactattgatgatatagaaatgaaaaattgctctttcaatattaccacaggcataagagataaggtgaagagagaatatgcactgttttataaagttgatgtagtaccaatagagaagaataccagttataggttgatacattgtaacacctcaaccatcacacaggcctgtccaaaggtatcctttgagccaattcccatacattactgtgccccggctggttttgcgattctaaagtgtaaagataagaagttcaatggaacaggactatgtacaaatgtcagcacagtacagtgtacacatggaattaggccagtagtgtcaactcaactgctgttaaatggtagtctagcagaagaagaggtagtaattagatctcagaatttcacagacaatgtcaaaaccataatagtacagctgaatgaatctgtagtgattaattgtacaagacccaacaataatacaagaaaaagtatacatataggaccagggggagcattctatacaacaggacaagtaataggaaatataagacaggcatattgcaacattagtgaagaacaatggaataaaactttaaaatacatagttgaaaaattaagagaacaatttggaaataaaacaataatctttaatcaatcctcaggaggggatccagaaattgtaacgcacagttttaattgtggaggagaattcttctactgtaatacatcacggctgtttaatagtacttggaatattactgaagggtcaaatagcactgcaggctctaacaagaatatcacactcccatgcaggataaaacaaattataaacatgtggcaggaagtaggaaaagcaatgtatgcccctcccatcagcggactaattagatgtacatcaaatattacagggctgttactaacaagagatggtggtcatgataataaaacaaatgacaccgagatcttcagacctggaggaggaaacatgagggacaattggagaagtgaattatataaatataaagtagtaaaaattgaaccattaggaatagcacccaccaaggcaaggagaagagtggtgcaaagagacaaaagagcagtgggaataggagctatgttccttgggatcttaggagcagcaggaagcactatgggcgcagcgtcaataacgctgacggtacaggccagacaactattgtctggtatagtgcaacagcagaacaatttgctgagggccattgaggcgcaacagcatctgttgcaactcacagtctggggcataaagcaactccaggcaagagtcctggctgtggaaagatacctaaaggatcaacagctcctagggatttggggatgctctggaaaactcatctgcaccactaatgtgccttggaatactagttggagtaatagatctctggactatatttgggggaacatgacctggatacagtgggaaagggaaattgacaattacacagacttaatatacaccttaattgaagaatcgcaagaccaacaagaaaagaatgaactagaattaatgaaactagataagtgggacagtctgtggagttggtttagcataacaaactggctgtggtatataagattattcataattatagtaggaggcttagtaggtttaagaatagtttttactgtactttctatagtgaatagagttaggcagggatactcaccattgtcatttcagacccgcctccaagcccccaggggacccgacaggcccgaaggaatcgaagaagaaggtggagacagagacagagacagatccgtgcgcttagtggatggattcttagcacttctctgggaagatctgaggagcctgttcctcttcagctaccgccacttgagagacttactcttgattgtagcgaggactgtggaacttctgggacgcagggggagggaagccctcaaatacgggtggaatcttctgctgtattggagtcaggaactaaagaatagtgctgttagtttgctcaatgctacagctataacagtagctgaggggacagatagggctatagaactaatacaaagagcttttagggcttttcttcgcatacctacaagaataagacagggcttggaaagggctttgctataaaatgggtg

SEQ ID NO: 212 - DNA, 2517 bp, herpes simplex virus
atggggaatggtttatggttcgtgggggttattattttgggcgctgcgtggggtcaggtccacgactggactgagcagacagatccatggtttttggatggcctgggcatggaccgcatgtactggcgcgacacgaacaccgggcgtctgtggctgccaaacacccccgacccccaaaaaccaccgcgcggatttctggcgccgccggacgaactaaacctgactacggcatctctgccccttcttcgctggtacgaggagcgcttttgttttgtattggtcaccacggccgagtttccgcgggaccccggccagctgctttacatcccgaagacctacctgctcggccggcccccgaacgcgagcctgcccgcccccaccacggtcgagccgaccgcccagcctccccccgcggtcgccccccttaagggtctcttgcacaatccaaccgcctccgtgttgctgcgttcccgggcctgggtaacgttttcggccgtccctgaccccgaggccctgacgttcccgcggggagacaacgtggcgacagcgagccacccgagcgggccgcgtgatacaccgcccccccgaccgccggttggggcccggcggcatccgacgacggagctggacatcacgcacctgcacaacgcgtccacgacctggttggccacccggggcctgttgagatccccaggtaggtacgtgtatttctccccgtcggcctcgacgtggcccgtgggcatctggacgacgggggagctggtgctcgggtgcgatgccgcgctggtgcgcgcgcgctacgggcgggaattcatggggctcgtgatatccatgcacgacagccctccggcggaagtgatggtggtccccgcgggccagacgctagatcgggtcggggaccccgcggacgaaaaccccccgggggctcttcccgggcccccgggcggcccccggtatcgggtctttgtcctagggtccctgacgcgggccgacaacggctccgcgctggacgccctccgccgcgtgggcggctacccggaggagggcacgaactacgcccagttcctgtcgcgggcatacgcggagtttttctcgggggacgcgggcgccgagcagggcccgcgcccccctctcttctggcgcctaacggggctgctcgcgacgtcgggttttgctttcgtgaacgccgcccacgcaaacggcgcggtctgcctctccgacctgctaggctttttggcccactcgcgcgcgcttgccgggttggccgcccgcggggccgcgggctgtgccgcggattctgtgttttttaatgtgtcagtcttggatcccacggcccgcctgcagctagaggctcggctccagcacctggtggccgagattctggagcgcgaacagagcttggcattacacgcgctgggctatcagctggccttcgtgctggatagcccctcggcgtacgacgcagtggcgcccagcgcagcccatctcatcgacgccctgtatgccgagtttctagggggccgcgtcgtgaccaccccggtcgtccaccgggcgctattttacgcctcggctgtcctccggcagccgttcttggcgggcgtcccctcggcggtgcagcgggaacgcgcccgccggagccttctgatagcctcggccctgtgtacgtccgacgtcgccgcagcgaccaacgccgacctccggaccgcgctggcccgggccgaccaccagaaaaccctcttttggcttccggaccacttttcgccatgcgcggcctccctgcgctttgatctagacgagagcgtgtttatcctggacgcgctggctcaagccacccgatccgagaccccggtcgaagtcctggcccagcagacccacggcctcgcctcgaccctgacgcgctgggcacactacaacgccctgatccgcgccttcgtccctgaggcctcacatcggtgcggggggcagtctgccaacgtcgagccacggatcctggtacccatcacccacaacgccagctacgtcgtcacccactcccctctgccccgggggatcggctacaagctcaccggcgtcgacgtccgacgcccactgttcctaacctacctcaccgcgacatgcgaaggctccacccgggatatcgagtccaagcggctggtgcgcacccaaaaccagcgcgacctggggctcgtgggggccgtgtttatgcgctacaccccggccggggaggtcatgtctgtgttgttggtggatacggacaacacacagcagcaaatcgccgccgggccgacggagggcgccccaagcgtgttttcgagcgacgtgccgtccacggccttgttgctatttccaaacggaaccgtcattcatttgctagcctttgacacgcagcccgtggccgcaattgcgcccgggtttctggccgcctctgcgctgggcgtggttatgattaccgccgccctggctggcatcctaaaggttctccggacaagtgtcccgtttttttggagacgcgaataa

SEQ ID NO: 213 - DNA, 675 bp, herpes simplex virus
atggggattttgggttgggtcgggcttattgccgttgggattttgtgtgtgcgggggggcttgccttcaaccgaatatgttattcggagtcgggtggctcgagaggtgggggatatattaaaggtgccttgtgtgccgctcccgtctgacgatcttgattggcgctacgagaccccctcggctataaactatgctttgatagacggtatatttttgcgttatcactgtcccggattggacacggtcttgtgggataggcacgcccagagggcgtattgggttaacccctttttgtttggggcgggttttttggaggacttgagtcatcccgcgtttcctgccgacacccaggaaacagaaacgcgcttggccctttataaagagatacgccaggcgctggacagtcgcaagcaggccgccagccacacacctgtgaaggctgggtgtgtgaactttgactattcgcgcacccgccgctgtgtagggcgccaggatttgggacttaccaacagaacgtctggacggaccccggttctgccgtcggacgatgaagcgggcctgcagccgaagcccctcaccacgccgtcgcccatcatcgccacgtcggaccccaccccgcgacgggacgccgccacaaaaagcagacgccgacgaccccacttccggggcctttaa

SEQ ID NO: 214 - protein, 584 aa, Influenza B virus
MKAIIVLLMVVTSNADRICTGITSSNSPHVVKTATQGEVNVTGVIPLTTTPTKSHFANLKGTQTRGKLCPNCFNCTDLDVALGRPKCMGNTPSAKVSILHEVKPATSGCFPIMHDRTKIRQLPNLLRGYENIRLSTSNVINTETAPGGPYKVGTSGSCPNVANGNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNYLSELEVKNLQRLSGAMNELHDEILELDEKVDDLRADTISSQIELAVLLSNEGIINSEDEHLLALERKLKKMLGPSAVEIGNGCFETKHKCNQTCLDRIAAGTFNAGDFSLPTFDSLNITAASLNDDGLDNHTILLYYSTAASSLAVTLMIAIFIVYMVSRDNVSCSICL

SEQ ID NO: 215 - DNA, 1836 bp, Influenza virus HA
ttgtctactcatggtagtacatccaatgcagatcgaatctgcactgggataacatcgtcaaactcaccacatgttgtcaaaactgctactcaaggggaggtcaatgtgactggtgtaataccactgacaacaacacccaccaaatctcattttgcaaatctcaaaggaacagaaaccagagggaaactatgcccaaaatgcctcaactgcacagatctggacgtggccttgggcagaccaaaatgcacggggaacataccctcggcaagagtttcaatactccatgaagtcagacctgttacatctgggtgctttcctataatgcacgacagaacaaaaattagacagctgcctaaacttctcagaggatacgaacatatcaggttatcaactcataacgttatcaatgcagaaaatgcaccaggaggaccctacaaaattggaacctcagggtcttgccctaacgttaccaatggaaacggatttttcgcaacaatggcttgggccgtcccaaaaaacgacaacaacaaaacagcaacaaattcattaacaatagaagtaccatacatttgtacagaaggagaagaccaaattaccgtttgggggttccactctgataacgaaacccaaatggcaaagctctatggggactcaaagccccagaagttcacctcatctgccaacggagtgaccacacattacgtttcacagattggtggcttcccaaatcaaacagaagacggaggactaccacaaagtggtagaattgttgttgattacatggtgcaaaaatctgggaaaacaggaacaattacctatcaaagaggtattttattgcctcaaaaagtgtggtgcgcaagtggcaggagcaaggtaataaaaggatccttgcctttaattggagaagcagattgcctccacgaaaaatacggtggattaaacaaaagcaagccttactacacaggggaacatgcaaaggccataggaaattgcccaatatgggtgaaaacacccttgaagctggccaatggaaccaaatatagacctcctgcaaaactattaaaggaaaggggtttcttcggagctattgctggtttcttagaaggaggatgggaaggaatgattgcaggttggcacggatacacatcccatggggcacatggagtagcggtggcagcagaccttaagagcactcaagaggccataaacaagataacaaaaaatctcaactctttgagtgagctggaagtaaagaatcttcaaagactaagcggtgccatggatgaactccacaacgaaatactagaactagacgagaaagtggatgatctcagagctgatacaataagctcacaaatagaactcgcagtcctgctttccaatgaaggaataataaacagtgaagatgagcatctcttggcgcttgaaagaaagctgaagaaaatgctgggcccctctgctgtagagatagggaatggatgctttgaaaccaaacacaagtgcaaccagacctgtctcgacagaatagctgctggtacctttgatgcaggagaattttctctccccacttttgattcactgaatattactgctgcatctttaaatgacgatggattggataatcatactatactgctttactactcaactgctgcctccagtttggctgtaacattgatgatagctatctttgttgtttatatggtctccagagacaatgtttcttgctccatctgtctataaggaaagttaaaccctgtattttcctttattgtagtgcttgtttgcttgttaccattacaaaaaacgttattgaaaaatgctcttgttactact

SEQ ID NO: 216 - DNA, 1698 bp, Influenza virus HA
atgaaagtaaaactactggttctgttatgtacatttacagctacatatgcagacacaatatgtataggctaccatgccaacaactcgaccgacactgttgacacagtacttgagaagaatgtgacagtgacacactctgtcaacctacttgaggacagtcacaatggaaaactatgtctactaaaaggaatagccccactacaattgggtaattgcagcgttgccggatggatcttaggaaacccagaatgcgaattactgatttccaaggaatcatggtcctacattgtagagacaccaaatcctgagaatggaacatgttacccagggtatttcgccgactatgaggagctgagagagcaattgagttcagtatcttcatttgagaggttcgaaatattccccaaagagagctcatggcccaaccacaycgtaaccggagtatcagcatcatgctcccataacgggaaaagcagtttttacagaaatttgctatggctgacggggaagaatggtttgtatccaaacctgagcaagtcctatgcaaacaacaaagagaaagaagtccttgtactgtggggtgttcatcacccgcctaacatargggaccaaagggccctctatcatacagaaaatgcttatgtctctgtagtgtcttcacattatagcagaagattcaccccagaaatagccaaaagacccaaggtgagagatcaggaaggaagaatcaactactactggactctgcttgaacccggggatacaataatatttgaggcaaatggaaatctaatagcgccaaggtttgctttcgcactgagtagaggctttggatcaggaatcatcacctcaaatgcaccaatggatgaatgtgatgcgaaatgtcaaacacctcagggagctataaacagcagtcttcctttccagaatgtacacccagtcacaataggagagtgtccaaagtatgtcaggagtacaaaattaagaatggttacaggactaaggaacatcccatccattcaatccagaggtttgtttggagccattgccggtttcattgaaggggggtggactggaatggtagatggatggtatggttaccaccatcagaatgagcaaggatctgggtatgctgctgatcaaaaaagcacacaaaatgccattaacgggattacaaacaaggtgaattctgtaattgagaaaatgaacactcaattcacagctgtgggcaaagaattcaacaaattggaaagaaggatggaaaacttaaataaaaaagttgatgatgggtttctagacatttggacatataacgcagaattgttggttctactggaaaatgaaaggactttggactttcatgactccaacgtgaagaatctgtatgagaaagtaaaaagccaattaaagaataatgccaaagaaataggaaacgggtgttttgaattctatcacaagtgtaacgatgaatgcatggagagtgtgaaaaatggaacttatgactatccaaaatattccgaagaatcaaagttgaacagggagaaaattgatggagtgaaattggaatcaatgggagtctatcagattttggcgatctactcaacagtcgccagttccctggttcttttggtctccctgggggcaatcagcttctggatgtgttccaatgggtctttgcagtgtagaatatgcatctaa

SEQ ID NO: 217 - DNA, 1706 bp, Influenza virus HA
atgaagactatcattgctttgagctacattctatgtctggttttcgctcaaaaacttcccggaaatgacaacagcacggcaacgctgtgccttgggcaccatgcagtaccaaacggaacaatagtgaaaacaatcacgaatgaccaaattgaagttactaatgctactgagctggttcagagttcctcaacaggtggaatatgcgacagtcctcatcagatccttgatggagaaaactgcacactaatagatgctctattgggagaccctcagtgtgatggcttccaaaataagaaatgggacctttttgttgaacgcagcaaagcctacagcaactgttacccttatgatgtgccggattatgcctcccttaggtcactagttgcctcatccggcacactggaatttaacaatgaaagcttcaattggactggagtcactcaaaatggaacaagctctgcttgcaaaaggggatctaataaaagtttctttagtagattgaattggttgacccacttaaaattcaaatacccagcattgaacgtgactatgccaaacaatgaaaaatttgacaaattgtacatttggggggttcaccacccgggtacggacaatgaccaaatcagcctatatgctcaagcatcaggaagaatcacagtctctaccaaaagaagccaacaaactgtaatcccgaatatcggatctagacccagggtaagggatatccccagcagaataagcatctattggacaatagtaaaaccgggagacatacttttgattaacagcacagggaatctaattgctcctcggggttacttcaaaatacgaagtgggaaaagctcaataatgagatcagatgcacccattggcaaatgcaattctgaatgcatcactccaaatggaagcattcccaatgacaaaccatttcaaaatgtaaacaggatcacatatggggcctgtcccagatatgttaagcaaaacactctgaaattggcaacagggatgcgaaacgtaccagagaaacaaactagaggcatatttggcgcaatcgcgggtttcatagaaaatggttgggagggaatggtggacggttggtacggtttcaggcatcaaaattctgagggaacaggacaagcagcagatctcaaaagcactcaagcagcaatcaaccaaatcaatgggaagctgaataggttgatcgggaaaacaaacgaaaaattccatcagattgaaaaagaattctcagaagtagaagggagaattcaggacctcgagaaatatgttgaggacactaaaatagatctctggtcatacaacgcggagcttcttgttgccctggagaaccaacatacaattgatctaactgactcagaaatgaacaaactgtttgaaagaacaaagaagcaactgagggaaaatgctgaggatatgggcaatggttgtttcaaaatataccacaaatgtgacaatgcctgcatagggtcaatcagaaatggaacttatgaccatgatgtatacagagatgaagcattaaacaaccggttccagatcaaaggtgttgagctgaagtcaggatacaaagattggatcctatggatttcctttgccatatcatgttttttgctttgtgttgctttgttggggttcatcatgtgggcctgccaaaaaggcaacattaggtgcaacatttgcatttgagtgca

SEQ ID NO: 218 - DNA, 1760 bp, Influenza virus HA
gcaggggtataatctgtcaaaatggagaaaatagtgcttcttcttgcaatagtcagtcttgtcaaaagtgatcagatttgcattggttaccatgcaaacaactcgacagagcaggttgacacaataatggaaaagaacgttactgttacacatgcccaagacatactggaaaagacacacaatgggaagctctgcgatctaaatggagtgaagcctctcattttgagagattgtagtgtagctggatggctcctcggaaaccctatgtgtgacgaattcatcaatgtgccggaatggtcttacatagtggagaaggccagtccagccaatgacctctgttacccaggggatttcaacgactatgaagaactgaaacacctattgagcagaacaaaccattttgagaaaattcagatcatccccaaaagttcttggtccaatcatgatgcctcatcaggggtgagctcagcatgtccataccatgggaggtcctcctttttcagaaatgtggtatggcttatcaaaaagaacagtgcatacccaacaataaagaggagctacaataataccaaccaagaagatcttttagtactgtgggggattcaccatcctaatgatgcggcagagcagacaaagctctatcaaaacccaaccacttacatttccgttggaacatcaacactgaaccagagattggttccagaaatagctactagacccaaagtaaacgggcaaagtggaagaatggagttcttctggacaattttaaagccgaatgatgccatcaatttcgagagtaatggaaatttcattgctccagaatatgcatacaaaattgtcaagaaaggggactcagcaattatgaaaagtgaattggaatatggtaactgcaacaccaagtgtcaaactccaatgggggcgataaactctagtatgccattccacaacatacaccccctcaccatcggggaatgccccaaatatgtgaaatcaaacagattagtccttgcgactggactcagaaatacccctcagagagagagaagaagaaaaaagagaggactatttggagctatagcaggttttatagagggaggatggcagggaatggtagatggttggtatgggtaccaccatagcaatgagcaggggagtggatacgctgcagacaaagaatccactcaaaaggcaatagatggagtcaccaataaggtcaactcgatcattgacaaaatgaacactcagtttgaggccgttggaagggaatttaataacttggaaaggaggatagagaatttaaacaagcagatggaagacggattcctagatgtctggacttataatgctgaacttctggttctcatggaaaatgagagaactctagactttcatgactcaaatgtcaagaacctttatgacaaggtccgactacagcttagggataatgcaaaggagctgggtaatggttgtttcgagttctatcacaaatgtgataatgaatgtatggaaagtgtaaaaaacggaacgtatgactacccgcagtattcagaagaagcaagactaaacagagaggaaataagtggagtaaaattggaatcaatgggaacttaccaaatactgtcaatttattcaacagtggcgagttccctagcactggcaatcatggtagctggtctatctttatggatgtgctccaatggatcgttacaatgcagaatttgcatttaaatttgtgagttcagattgtagttaaaaacacc

SEQ ID NO: 219 - DNA, 1049 bp, Influenza virus HA
ttgcttgtgtgctggttgaagctaagggagacaaaatatgccttgggcaccatgctgtggtaaatgggacaaaggtgaacacgctaacagagaaggggattgaagtagtgaatgctacggagacggtagaaactgcgaatatcgggaaaatctgcacccaagggaaaaggccaaccgacctgggacaatgtggactcctaggaaccctaataggacctccccaatgtgatcagttcctggagtttgaatctgatttaataattgagcgaagagaaggaaatgatgtgtgctatcctgggaaattcacaaatgaggaatcactaaggcagatccttcgagggtcaggaggaatcgataaagagtcgatgggtttcacatatagtggaataataaccaatggagcaacaagtgcttgcagaagatcaggttcttccttctatgcggagatgaagtggttgctgtcaaattctgacaatgcagcattcccccaaatgaccaaatcatatagaaatcccagaaacaaaccagccctaatagtttggggaattcatcattctggatcgactactgagcagaccaaactctatggaagtggaaacaagttgataactgtagaaagctcgaaatatcagcaatcgttcaccccgagtccgggagcacggccacaagtaaatggagagtctgggagaatcgatttccattggatgcttcttgatcccaacgacacagtgactttcaccttcaatggggcattcatagcccctgacagagcaagtttcttcaaaggagaatcactaggagtccagagtgatgttcccttagactctagttgtggaggggattgctttcacagtggaggtacaatagtcagttctctgccattccaaaacattaaccctagaacagtgggaaaatgcccccgatatgtcaaacagccaagcctccttttggctactggaatgaggaatgtcccagagaatccaaagaccagaggactttttggagcaattgccggattcatagagaaggatggagggtctcattacggg

SEQ ID NO: 220 - DNA, 1714 bp, Influenza virus HA
gcaaaagcaggggaattacttaactagcaaaatggaaacaatatcactaataactatactactagtagtaacagcaagcaatgcagataaaatctgcatcggccaccagtcaacaaactccacagaaactgtggacacgctaacagaaaccaatgttcctgtgacacatgccaaagaattgctccacacagagcataatggaatgctgtgtgcaacaagcctgggacatcccctcattctagacacatgcactattgaaggactagtctatggcaacccttcttgtgacctgctgttgggaggaagagaatggtcctacatcgtcgaaagatcatcagctgtaaatggaacgtgttaccctgggaatgtagaaaacctagaggaactcaggacactttttagttccgctagttcctaccaaagaatccaaatcttcccagacacaacctggaatgtgacttacactggaacaagcagagcatgttcaggttcattctacaggagtatgagatggctgactcaaaagagcggtttttaccctgttcaagacgcccaatacacaaataacaggggaaagagcattcttttcgtgtggggcatacatcacccacccacctataccgagcaaacaaatttgtacataagaaacgacacaacaacaagcgtgacaacagaagatttgaataggaccttcaaaccagtgatagggccaaggccccttgtcaatggtctgcagggaagaattgattattattggtcggtactaaaaccaggccaaacattgcgagtacgatccaatgggaatctaattgctccatggtatggacacgttctttcaggagggagccatggaagaatcctgaagactgatttaaaaggtggtaattgtgtagtgcaatgtcagactgaaaaaggtggcttaaacagtacattgccattccacaatatcagtaaatatgcatttggaacctgccccaaatatgtaagagttaatagtctcaaactggcagtcggtctgaggaacgtgcctgctagatcaagtagaggactatttggagccatagctggattcatagaaggaggttggccaggactagtcgctggctggtatggtttccagcattcaaatgatcaaggggttggtatggctgcagatagggattcaactcaaaaggcaattgataaaataacatccaaggtgaataatatagtcgacaagatgaacaagcaatatgaaataattgatcatgaattcagtgaggttgaaactagactcaatatgatcaataataagattgatgaccaaatacaagacgtatgggcatataatgcagaattgctagtactacttgaaaatcaaaaaacactcgatgagcatgatgcgaacgtgaacaatctatataacaaggtgaagagggcactgggctccaatgctatggaagatgggaaaggctgtttcgagctataccataaatgtgatgatcagtgcatggaaacaattcggaacgggacctataataggagaaagtatagagaggaatcaagactagaaaggcagaaaatagagggggttaagctggaatctgagggaacttacaaaatcctcaccatttattcgactgtcgcctcatctcttgtgcttgcaatggggtttgctgccttcctgttctgggccatgtccaatggatcttgcagatgcaacatttgtatataa

SEQ ID NO: 221 - DNA, 1640 bp, Nipah virus
ttatacttgacaagagatgttattgtaatcttttaatattgattttgatgatctcggagtgtagtgttgggattctacattatgagaaattgagtaaaattggacttgtcaaaggagtaacaagaaaatacaagattaaaagcaatcctctcacaaaagacattgttataaaaatgattccgaatgtgtcgaacatgtctcagtgcacagggagtgtcatggaaaattataaaacacgattaaacggtatcttaacacctataaagggagcgttagagatctacaaaaacaacactcatgaccttgtcggtgatgtgagattagccggagttataatggcaggagttgctattgggattgcaaccgcagctcaaatcactgcaggtgtagcactatatgaggcaatgaagaatgctgacaacatcaacaaactcaaaagcagcattgaatcaactaatgaagctgtcgttaaacttcaagagactgcagaaaagacagtctatgtgctgactgctctacaggattacattaatactaatttagtaccgacaattgacaagataagctgcaaacagacagaactctcactagatctggcattatcaaagtacctctctgatttgctttttgtatttggccccaaccttcaagacccagtttctaattcaatgactatacaggctatatctcaggcattcggtggaaattatgaaacactgctaagaacattgggttacgctacagaagactttgatgatcttctagaaagtgacagcataacaggtcaaatcatctatgttgatctaagtagctactatataattgtcagggtttattttcctattctgactgaaattcaacaggcctatatccaagagttgttaccagtgagcttcaacaatgataattcagaatggatcagtattgtcccaaatttcatattggtaaggaatacattaatatcaaatatagagattggattttgcctaattacaaagaggagcgtgatctgcaaccaagattatgccacacctatgaccaacaacatgagagaatgtttaacgggatcgactgagaagtgtcctcgagagctggttgtttcatcacatgttcccagatttgcactatctaacggggttctgtttgccaattgcataagtgttacatgtcagtgtcaaacaacaggcagggcaatctcacaatcaggagaacaaactctgctgatgattgacaacaccacctgtcctacagccgtactcggtaatgtgattatcagcttagggaaatatctggggtcagtaaattataattctgaaggcattgctatcggtcctccagtctttacagataaagttgatatatcaagtcagatatccagcatgaatcagtccttacaacagtctaaggactatatcaaagaggctcaacgactccttgatactgttaatccatcattaataagcatgttgtctatgatcatactgtatgtattatcgatcgcatcgttgtgtatagggttgattacatttatcagttttatcattgttgagaaaaagagaaacacctacagcagattagaggataggagagtcagacctacaagcagtggggatctctactacattgggacatagtgtatt

SEQ ID NO: 222 - DNA, 1725 bp, respiratory syncytial virus
atggagctgctgatccacaggttaagtgcaatcttcctaactcttgctattaatgcattgtacctcacctcaagtcagaacataactgaggagttttaccaatcgacatgtagtgcagttagcagaggttattttagtgctttaagaacaggttggtataccagtgtcataacaatagaattaagtaatataaaagaaaccaaatgcaatggaactgacactaaagtaaaacttataaaacaagaattagataagtataagaatgcagtgacagaattacagctacttatgcaaaacacaccagctgccaacaaccgggccagaagagaagcaccacagtatatgaactatacaatcaataccactaaaaacctaaatgtatcaataagcaagaagaggaaacgaagatttctgggcttcttgttaggtgtaggatctgcaatagcaagtggtatagctgtatccaaagttctacaccttgaaggagaagtgaacaagatcaaaaatgctttgttatctacaaacaaagctgtagtcagtctatcaaatggggtcagtgttttaaccagcaaagtgttagatctcaagaattacataaataaccaattattacccatagtaaatcaacagagctgtcgcatctccaacattgaaacagttatagaattccagcagaagaacagcagattgttggaaatcaacagagaattcagtgtcaatgcaggtgtaacaacacctttaagcacttacatgttaacaaacagtgagttactatcattgatcaatgatatgcctataacaaatgatcagaaaaaattaatgtcaagcaatgttcagatagtaaggcaacaaagttattctatcatgtctataataaaggaagaagtccttgcatatgttgtacagctacctatctatggtgtaatagatacaccttgctggaaattacacacatcacctctatgcaccaccaacatcaaagaaggatcaaatatttgtttaacaaggactgatagaggatggtattgtgataatgcaggatcagtatccttctttccacaggctgacacttgtaaagtacagtccaatcgagtattttgtgacactatgaacagtttgacattaccaagtgaagtcagcctttgtaacactgacatattcaattccaagtatgactgcaaaattatgacatcaaaaacagacataagcagctcagtaattacttctcttggagctatagtgtcatgctatggtaaaactaaatgcactgcatccaacaaaaatcgtgggattataaagacattttctaatggttgtgactatgtgtcaaacaaaggagtagatactgtgtcagtgggcaacactttatactatgtaaacaagctggaaggcaagaacctttatgtaaaaggggaacctataataaattactatgaccctctagtgtttccttctgatgagtttgatgcatcaatatctcaagtcaatgaaaaaatcaatcaaagtttagcttttattcgtagatctgatgaattactacataatgtaaatactggcaaatctactacaaatattatgataactacaattattatagtaatcattgtagtattgttatcattaatagctattggtttgctgttgtattgcaaagccaaaaacacaccagttacactaagcaaagaccaactaagtggaatcaataatattgcattcagcaaatag

SEQ ID NO: 223 - DNA, 3770 bp, SARS virus
catgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagctcgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaa

SEQ ID NO: 224 - DNA, 2784 bp, Varicella zoster
tattattcaaagtggagaaacagggatcgaccagaataccgtcgtaatctacgattcagacgttttttctcttctatacaccctaatgcagcggctggctccggattcaacggacccggcgttttcataacctccgttacgggggtgtggttatgctttttatgcatattttctatgtttgttacggcggttgtgtcggtctctccaagctcgttttatgagagtttacaagtagagcccacacaatcagaagatataacccggtctgctcatctgggcgatggtgatgaaatcagagaagctatacacaagtcccaggacgccgaaacaaaacccacgttttacgtctgcccaccgccaacaggctccacaatcgtacgattagaaccaactcggacatgtccggattatcaccttggtaaaaactttacagagggtattgctgttgtttataaagaaaacattgcagcgtacaagtttaaggcgacggtatattacaaagatgttatcgttagcacggcgtgggccggaagttcttatacgcaaattactaatagatatgcggatagggtaccaattcccgtttcagagatcacggacaccattgataagtttggcaagtgttcttctaaagcaacgtacgtacgaaataaccacaaagttgaagcctttaatgaggataaaaatccacaggatatgcctctaatcgcatcaaaatataattctgtgggatccaaagcatggcatactaccaatgacacgtacatggttgccggaacccccggaacatataggacgggcacgtcggtgaattgcatcattgaggaagttgaagccagatcaatattcccttatgatagttttggactttccacgggagatataatatacatgtccccgttttttggcctacgggatggtgcatacagagaacattccaattatgcaatggatcgttttcaccagtttgagggttatagacaaagggatcttgacactagagcattactggaacctgcagcgcggaactttttagtcacgcctcatttaacggttggttggaactggaagccaaaacgaacggaagtttgttcgcttgtcaagtggcgtgaggttgaagacgtagttcgcgatgagtatgcacacaattttcgctttacaatgaaaacactttctaccacgtttataagtgaaacaaacgagtttaatcttaaccaaatccatctcagtcaatgtgtaaaggaggaagcccgggctattattaaccggatctatacaaccagatacaactcatctcatgttagaaccggggatatccagacctaccttgccagaggggggtttgttgtggtgtttcaacccctgctgagcaattccctcgcccgtctctatctccaagaattggtccgtgaaaacactaatcattcaccacaaaaacacccgactcgaaataccagatcccgacgaagcgtgccagttgagttgcgtgccaatagaacaataacaaccacctcatcggtggaatttgctatgctccagtttacatatgaccacattcaagagcatgttaatgaaatgttggcacgtatctcctcgtcgtggtgccagctacaaaatcgcgaacgcgccctttggagcggactatttccaattaacccaagtgctttagcgagcaccattttggatcaacgtgttaaagctcgtattctcggcgacgttatctccgtttctaattgtccagaactgggatcagatacacgcattatacttcaaaactctatgagggtatctggtagtactacgcgttgttatagccgtcctttaatttcaatagttagtttaaatgggtccgggacggtggagggccagcttggaacagataacgagttaattatgtccagagatctgttagaaccatgcgtggctaatcacaagcgatattttctatttgggcatcactacgtatattatgaggattatcgttacgtccgtgaaatcgcagtccatgatgtgggaatgattagcacttacgtagatttaaacttaacacttcttaaagatagagagtttatgccgctgcaagtatatacaagagacgagctgcgggatacaggattactagactacagtgaaattcaacgccgaaatcaaatgcattcgctgcgtttttatgacatagacaaggttgtgcaatatgatagcggaacggccattatgcagggcatggctcagtttttccagggacttgggaccgcgggccaggccgttggacatgtggttcttggggccacgggagcgctgctttccaccgtacacggatttaccacgtttttatctaacccatttggggcattggccgtgggattattggttttggcgggactggtagcggccttttttgcgtaccggtacgtgcttaaacttaaaacaagcccgatgaaggcattatatccactcacaaccaaggggttaaaacagttaccggaaggaatggatccctttgccgagaaacccaacgctactgataccccaatagaagaaattggcgactcacaaaacactgaaccgtcggtaaatagcgggtttgatcccgataaatttcgagaagcccaggaaatgattaaatatatgacgttagtatctgcggctgagcgccaagaatctaaagcccgcaaaaaaaataagactagcgcccttttaacttcacgtcttaccggccttgctttacgaaatcgccgaggatactcccgtgttcgcaccgagaatgtaacgggggtgtaaata

SEQ ID NO: 225 - DNA, 2000 bp, Varicella zoster
gcggggatgttttatgaagccttaaaggccgagctggtatacacgagagcagtccatggttttagacctcgggcgaattgcgtggttttaagtgactatattccgagggtcgcctgtaatatggggacagttaataaacctgtggtgggggtattgatggggttcggaattatcacgggaacgttgcgtataacgaatccggtcagagcatccgtcttgcgatacgatgattttcacaccgatgaagacaaactggatacaaactccgtatatgagccttactaccattcagatcatgcggagtcttcatgggtaaatcggggagagtcttcgcgaaaagcgtacgatcataactcaccttatatatggccacgtaatgattatgatggatttttagagaacgcacacgaacaccatggggtgtataatcagggccgtggtatcgatagcggggaacggttaatgcaacccacacaaatgtctgcacaggaggatcttggggacgatacgggcatccacgttatccctacgttaaacggcgatgacagacataaaattgtaaatgtggaccaacgtcaatacggtgacgtgtttaaaggagatcttaatccaaaaccccaaggccaaagactcattgaggtgtcagtggaagaaaatcacccgtttactttacgcgcaccgattcagcggatttatggagtccggtacaccgagacttggagctttttgccgtcattaacctgtacgggagacgcagcgcccgccatccagcatatatgtttaaaacatacaacatgctttcaagacgtggtggtggatgtggattgcgcggaaaatactaaagaggatcagttggccgaaatcagttaccgttttcaaggtaagaaggaagcggaccaaccgtggattgttgtaaacacgagcacactgtttgatgaactcgaattagacccccccgagattgaaccgggtgtcttgaaagtacttcggacagaaaaacaatacttgggtgtgtacatttggaacatgcgcggctccgatggtacgtctacctacgccacgtttttggtcacctggaaaggggatgaaaaaacaagaaaccctacgcccgcagtaactcctcaaccaagaggggctgagtttcatatgtggaattaccactcgcatgtattttcagttggtgatacgtttagcttggcaatgcatcttcagtataagatacatgaagcgccatttgatttgctgttagagtggttgtatgtccccatcgatcctacatgtcaaccaatgcggttatattctacgtgtttgtatcatcccaacgcaccccaatgcctctctcatatgaattccggttgtacatttacctcgccacatttagcccagcgtgttgcaagcacagtgtatcaaaattgtgaacatgcagataactacaccgcatattgtctgggaatatctcatatggagcctagctttggtctaatcttacacgacgggggcaccacgttaaagtttgtagatacacccgagagtttgtcgggattatacgtttttgtggtgtattttaacgggcatgttgaagccgtagcatacactgttgtatccacagtagatcattttgtaaacgcaattgaagagcgtggatttccgccaacggccggtcagccaccggcgactactaaacccaaggaaattacccccgtaaaccccggaacgtcaccacttctacgatatgccgcatggaccggagggcttgcagcagtagtacttttatgtctcgtaatatttttaatctgtacggctaaacgaatgagggttaaagcctatagggtagacaagtccccgtataaccaaagcatgtattacgctggccttccagtggacgatttcgaggactcggaatctacggatacggaagaagagtttggtaacgcgattggagggagtcacgggggttcgagttacacggtgtatatagataagacccggtgatcaccgaa

SEQ ID NO: 226 - DNA, 1072 bp, Varicella zoster
atgtttttaatccaatgtttgatatcggccgttatattttacatacaagtgaccaacgctttgatcttcaagggcgaccacgtgagcttgcaagttaacagcagtctcacgtctatccttattcccatgcaaaatgataattatacagagataaaaggacagcttgtctttattggagagcaactacctaccgggacaaactatagcggaacactggaactgttatacgcggatacggtggcgttttgtttccggtcagtacaagtaataagatacgacggatgtccccggattagaacgagcgcttttatttcgtgtaggtacaaacattcgtggcattatggtaactcaacggatcggatatcaacagagccggatgctggtgtaatgttgaaaattaccaaaccgggaataaatgatgctggtgtgtatgtacttcttgttcggttagaccatagcagatccaccgatggtttcattcttggtgtaaatgtatatacagcgggctcgcatcacaacattcacggggttatctacacttctccgtctctacagaatggatattctacaagagccctttttcaacaagctcgtttgtgtgatttacccgcgacacccaaagggtccggtacctccctgtttcaacatatgcttgatcttcgtgccggtaaatcgttagaggataacccttggttacatgaggacgttgttacgacagaaactaagtccgttgttaaggaggggatagaaaatcacgtatatccaacggatatgtccacgttacccgaaaagtcccttaatgatcctccagaaaatctacttataattattcctatagtagcgtctgtcatgatcctcaccgccatggttattgttattgtaataagcgttaagcgacgtagaattaaaaaacatccaatttatcgcccaaatacaaaaacaagaaggggcatacaaaatgcgacaccagaatccgatgtgatgttggaggccgccattgcacaactagcaacgattcgcgaagaatcccccccacattccgttgtaaacccgtttgttaaatagaactaat

SEQ ID NO: 227 - protein, 9 aa, Influenza virus
YPYDVPDYA

SEQ ID NO: 228 - protein, 380 aa, Newcastle disease virus
MDSSRTIGLYFDSTLPSSNLLAFPIVLQDTGDGKKQITPQYRIQRLDSWTDSKEDSVFITTYGFIFQVGSEEVTVGTINDNPKHELLSSAMLCLGSVPNDGDLVELARACLTMVVTCKKSATNTERMVFSVVQAPRVLQSCMVVANRYSSVNAVKHVKVPEKIPGSGTLEYKVNFVSLTVVPKKDVYRIPTAALKVSGSSLYNLALNVTIDVEVDPKSPLVKSLSKSDSGYYANLFLHIGLMSTVDKKGKKVTFDKLEKKIRRLDLSVGLSDVLGPSVLVKARGVRTRLLAPFFSSSGTACYPIANASPQVAKILWSQTARLRSVKVIIQAGTQRAVAVTADHEVTSTKIEKRHTIAKYNPFKKSAASLRLQSARFPESP

SEQ ID NO: 229 - protein, 364 aa, Newcastle disease virus
MDSSRTIGLYFDSAHSSSNLLAFPIVLQDTGDGKKQIAPQYRIQRLDLWTDSKEDSVFITTYGFIFQVGNEEATVGIIDDKPKRELLSAAMLCLGSVPNTGDLIELARACLTMMVTCKKSATNTERMVFSVVQAPQVLQSCRVVANKYSSVNAVKHVKAPEKIPGSGTLEYKVNFVSLTVVPKKDVYKIPAAVLKISGSSLYNLALNVTINVEVDPRSPLVKSLSKSDSGYYANLFLHIGLMTTVDRKGKKVTFDKLEKKIRSLDLSVGLSDVLGPSVLVKARGARTKLLAPFFSSSGTACYPIANASPQVAKILWSQTACLRSVKIIIQAGTQRAVAVTADHEVTSTKLEKGHTLAKYNPFKK

SEQ ID NO: 230 - protein, 364 aa, Newcastle disease virus
MDSSRTIGLYFDSALPSSSLLAFPIVLQTTGDGKKQITPQYRIQRLDLWTDSKEDSVFITTYGFIFQVGDEEATVGTINDNPRQELLSSAMLCLGSVPNDGNLIELARACLTMVITCKKSATNTERMVFSIVQAPQVLQSCMVVANKYSSVNAVKHVKAPEKIPGSGTLEFKVNFVSLTVVPRKDVYRIPTAALKVSGSSLYNLALNVTIDVEVDPKSPLVKSLSKSDGGYYANLFLHIGLMSTVDKKGKKVTFDKLEEKIRRLNLSVGLSDVLGPSVLVKARGARTKLLAPFFSSSGTACYPIANASPQVAKILWSQTAHLRSVKAIIQAGTQRAVAVTSDHEVTSTKIEKGCAIAKYNPFKK

SEQ ID NO: 231 - protein, 364 aa, Newcastle disease virus
MDSSRTIGLYFDSALSSSNLLAFPIVLQDTGDGKKQIAPQYRIQRLDSWTDSKEDSVFITTYGFIFQVGNEEATVGMIDDKPKRELLSAAMLCLGSVPNTGDLVELARACLTMMVTCKKSATNTERMVFSVVQAPQVLQSCRVVANKYSSVNAVKHVKAPEKIPGSGTLEYKVNFVSLTVVPKKDVYKIPTAALKISGSSLYNLALNVTIDVEVDPKSPLVRSLSKSDSGYYANLFLHIGLMSTVDKKGKKVSFDKIEGKIRRLNLSVGLSDVLGPSVLVKARGARTKLLAPFFSSSGTACYPIANASPQVAKILWSQTAHLRSVKVIIQAGTQRAVAVTADHEVTSTKIEKRHTIAKYNPFKK

SEQ ID NO: 232 - protein, 364 aa, Newcastle disease virus
MDSSRTIGLYFDSALPSSSLLAFPIVLQDTGDGKKQITPQYRIQRLDSWTDSKEDSVFITTYGFIFQIGNEEVTVGMINDNPRHELLSSAMLCLGSVPNDGDLVELARACLTMVVTCKKSATNTERIVFSVVQAPRVLQSCMVVANRYSSVNAVKHVKAPEKIPGSGTLEYKVNFVSLTVVPRKDVYRIPTAALKISGSSLYNLALNVTIDVEVDPKSPLVKSLSKSDSGYYANLFLHIGLMSTVDKKGKKVTFDKIEGKIRRLNLSVGLSDVLGPSVLVKPRGARTKLLAPFFSSSGTACYPIANASPQVAKILWSQTAHLRSVKVIIQAGTQRAVAVTADHEVTSTKIEKKHTIAKYNPFKK

SEQ ID NO: 233 - protein, 364 aa, Newcastle disease virus
MDSSRTIGLYFDSALPSSSLLAFPIVLQTTGDGKKQITPQYRIQRLDSWTDSKEDSVFITTYGFIFQVGNEEVTVGTINDNPRQELLSSAMLCLGSVPNDGDLVELARACLTMVVTCKKSATNTERIVFSIVQAPRVLQSCMVVANRYSSVNAVKHVKAPEKIPGSGTLEYKVNFVSLTVVPRKDVYRIPTAALKVSGSSLYNLALNVTIDVEVDPKSPLVKSLSKSDSGYYANLFLHIGLMSTVDKKGKKVTFDKLERKIRRLNLSVGLSDVLGPSVLVKARGARTKLLAPFFSSSGTACYPIANASPQVAKILWSQTAHLRSVKVIIQAGTQRAVAVTADHEVTSTKIEKRHTIAKYNPFEK

SEQ ID NO: 234 - protein, 364 aa, Newcastle disease virus
MDSSRTIGLYFDSAHSSSNLLAFPIVLQGTGDGKKQIAPQYRIQRLDLWTDSKEDSVFITTYGFIFQVGNEEATVGMIDDKPKRELLSAAMLCLGSVPNTGDLIELARACLTMIVTCKKSATNTERMVFSVVQAPQVLQSCRVVANKYSSVNAVKHVKAPEKIPGSGTLEYKVNFVSLTVVPKKDVYKIPAAVLKVSGSSLYNLALNVTINVEVDPRSPLVKSLSKSDSGYYANLFLHIGLMTTVDRKGKKVTFDKLEKKIRSLDLSVGLSDVLGPSVLVKARGARTKLLAPFFSSSGTACYPIANASPQVAKILWSQTACLRSVKIIIQAGTQRAVAVTADHEVTSTKLEKGHTLAKYNPFKK

SEQ ID NO: 235 - protein, 364 aa, Newcastle disease virus
MDSSRTIGLYFDSALPSSSLLAFPIVLQDTGDGKKRITPQYRIQRLDSWTDSKEDSVFITTYGFIFQIGNEEVTVGMINDNPRHELLSSAMLCLGSVPNDGDLVELARACLTMAVTCKKSATNTERIVFSVVQAPRVLQSCMVVANRYSSVNAVKHVKAPEKIPGSGTLEYKVNFVSLTVVPRKDVYRIPTAALKISGSSLYNLALNVTIDVEVDPKSPLVKSLSKSDSGYYANLFLHIGLMSTVDRKGKKVTFDKIEGKIRRLNLSVGLSDVLGPSVLVKARGARTKLLAPFFSSSGTACYPIANASPQVAKILWSQTAHLRSVKVIIQAGTQRAVAVTADHEVTSTKIEKKHTIAKYNPFKK

SEQ ID NO: 236 - protein, 364 aa, Newcastle disease virus
MDSSRTIGLYFDSTLPSSNLLAFPIVLQDTRDGKKQITPQYRIQRLDSWTDSKEDSVFITTYGFIFQVGSEEVTVGMINDNPKHELLSSAMLCLGSVPNDGDLVELARACLTMVVTCKKSATNTERMVFSVVQAPRVLQSCTVVANRYSSVNAVKHVKVPEKIPGSGTLEYKVNFVSLTVVPRKDVYRIPTAALKVSGSSLYNLALNVTIDVEVDPKSPLVKSLSKSDSGYYANLFLHIGLMSTVDKKGKKVTFDKLERKIRRLDLSVGLSDVLGPSVLVKARGARTRLLAPFFSSSGTACYPIANASPQVAKILWSQTARLRSVKVIIQAGTQRAVAVTADHEVTSTKIEKRHTIAKYNPFKK

SEQ ID NO: 237 - protein, 364 aa, Newcastle disease virus
MDSSRTIGLYFDSALPSSSLLAFPIVLQDTGDGKKQITPQYRIQRLDSWTDSKEDSVFITTYGFIFQIGNEEATVGVINDNPKHELLSSAMLCLGSVPNDGDLVELARACLTMVVTCKKSATNTERIVFSVVQAPRVLQSCMVVANRYSSVNAVKHVKAPEKIPGSGTLEYKVNFVSLTVVPRRDVYRIPTAVLKVSGSSLYNLALNVTIDVDVDPKSPLVKSLSKSDSGYYANLFLHIGLMSTVDKKGKKVIFDKIEEKIRRLNLSVGLSDVLGPSVLVKARGARTKLLAPFFSSSGTACYPIANASPQVAKILWSQTAHLRSVKVIIQAGTQRAVAVTADHEVTSTKIERRHAIAKYNPFRK

SEQ ID NO: 238 - protein, 364 aa, Newcastle disease virus
MDSSRTIGLYFDSALPSSNLLAFPIVLQDTGDGKKQIAPQYRIQRLDSWTDSKEDSVFITTYGFIFQVGNEEATVGMINDNPKRELLSAAMLCLGSVPNVGDLVELARACLTMVVTCKKSATNNERMVFSVVQDPQVLQSCRVVANKYSPVNAVKYVKPPEKIPGIGTLEYQVNFVSLPVVPMQDVYKIPTAALKVSGSSLHNLALNVTIDVEVDPKSPLVKSLSKSDSGYYANLFLHIGLMSTVDKKGKKVTFDKLERKIRRLDLSVGLSDVLGPSVLVKARGARTKLLAPFFSSSGTACYPIANASPQVAKILWSQTACLRSVKVIIQAGTQRAVAVTADHEVTSTKLEKGHTIAKYNPFKK

SEQ ID NO: 239 - DNA, 1143 bp, Newcastle disease virus
atggactcatccaggacaatcgggctgtacttcgattccacccttccttccagcaacctgctagcattcccgatcgtcctacaagacacaggagatgggaagaagcaaatcaccccgcaatataggatccagcgtcttgactcgtggacagacagcaaagaagattcggtatttatcaccacttatggattcatcttccaggttgggagtgaggaagtcactgtcggcacgatcaatgataatcccaagcacgagttactttcctctgcgatgctctgcctaggaagtgtcccgaatgacggagatcttgttgagctggcgagggcctgccttactatggtggtaacatgcaagaagagtgcaactaatactgagagaatggtcttctcggtagtgcaagcaccccgggtactgcaaagctgtatggttgtggcgaacagatactcgtcagtgaatgcagttaagcacgtgaaagtaccagagaagatacctgggagcggaaccctagagtacaaggtgaactttgtctctttgacggtggtgccgaagaaggatgtctacaggatcccaaccgcagcattgaaagtgtctggctcgagcctgtacaatcttgcgctcaatgtcactattgatgtggaggtggacccgaagagcccgttagtcaaatccctttccaagtccgacagtggatactacgctaatctcttcttgcatatcggacttatgtccactgtagataagaaggggaagaaagtgacatttgacaagctggagaagaagataaggagactcgatctatccgtcgggctcagcgatgtgctcggaccttccgtgcttgtgaaggcgagaggtgtacggactaggctgctggcacctttcttctctagcagtgggacagcctgctatcctatagcaaatgcctctcctcaggtagccaagatactctggagtcaaactgcgcgcctgcggagtgtaaaagtcatcattcaagcgggcacccaacgcgctgtcgcagtgaccgctgaccatgaggttacctctactaagatagagaagaggcataccattgctaaatacaatcctttcaagaaatcggctgcatctctgagactgcaatccgcccgcttccccgaatcgccatga

SEQ ID NO: 240 - DNA, 1095 bp, Newcastle disease virus
atggactcatctaggacaattgggctgtactttgattctgcccattcttctagcaacctgttagcatttccgatcgtcctacaagacacaggagatgggaagaagcaaatcgccccgcaatataggatccagcgccttgacttgtggactgatagtaaggaagactcagtattcatcaccacctatggattcatctttcaagttgggaatgaagaagccactgtcggcattatcgatgataaacccaagcgcgagttactttccgctgcgatgctctgcctaggaagcgtcccaaataccggagaccttattgagctggcaagggcctgtctcactatgatggtcacatgcaagaagagtgcaactaatactgagagaatggttttctcagtagtgcaggcaccccaagtgctgcaaagctgtagggttgtggcaaacaaatactcatcagtgaatgcagtcaagcacgtgaaagcgccagagaagatccccgggagtggaaccctagaatacaaggtgaactttgtctccttgactgtggtaccgaagaaggatgtctacaagatcccagctgcagtattgaagatttctggctcgagtctgtacaatcttgcgctcaatgtcactattaatgtggaggtagacccgaggagtcctttggttaaatctctgtctaagtctgacagcggatactatgctaacctcttcttgcatattggacttatgaccaccgtagataggaaggggaagaaagtgacatttgacaagctggaaaagaaaataaggagccttgatctatctgtcgggctcagtgatgtgctcgggccttccgtgttggtaaaagcaagaggtgcacggactaagcttttggcacctttcttctctagcagtgggacagcctgctatcccatagcaaatgcttctcctcaggtggccaagatactctggagtcaaaccgcgtgcctgcggagcgttaaaatcattatccaagcaggtacccaacgcgctgtcgcagtgaccgctgaccacgaggttacctctactaagctggagaaggggcacacccttgccaaatacaatccttttaagaaataa

SEQ ID NO: 241 - DNA, 1095 bp, Newcastle disease virus
atggactcatccaggacaatcggactgtactttgattctgcccttccttccagcagcttgcttgctttcccgatcgtcttacagactacaggagatgggaagaagcaaatcaccccacaatataggatccagcgtcttgacttgtggacggacagcaaagaagattcggtattcatcaccacctacggattcattttccaagtcggggacgaagaagccactgtcggcacgatcaatgataaccccaggcaagagttactttcttctgcaatgctctgcctagggagtgttcctaatgacggaaatctcattgagctggcaagggcctgcctcactatggtgataacgtgcaagaagagtgcaaccaatactgagagaatggtcttctcaatagtgcaggcaccccaggtgctgcaaagctgtatggttgtggcaaataagtactcatcagtaaatgcagtaaaacatgtaaaagcaccagagaagatccccgggagcggaactctagagtttaaggtgaactttgtctctttgactgtagtgccaaggaaggatgtctacaggatccctaccgcagcattgaaagtatctggctcgagcctgtataatcttgcgctcaatgtcactattgatgtggaagtggacccaaagagcccattagtcaaatccctttccaagtccgatggcggatattatgccaatctcttcttacatatcgggcttatgtccactgtagataaaaagggaaagaaagtgacatttgacaagctggaagagaagataagaagactcaatctatctgttgggctcagtgatgtgctcggaccttccgtgctcgtgaaggcgagaggtgcacggaccaagctgctggcaccttttttctctagcagtgggacagcttgttaccctatagcaaatgcttctccccaggttgccaagatactttggagtcaaactgcgcacctgcgaagtgtaaaggccatcattcaagcgggcacccaacgtgctgtcgcagtgacctctgaccatgaggttacctctaccaagatagagaaggggtgcgccattgctaaatacaaccctttcaagaaatag

SEQ ID NO: 242 - DNA, 1095 bp, Newcastle disease virus
atggactcatctaggacaattgggctgtactttgattctgccctttcttctagcaacctgttagcatttccgatcgtcctacaagacacaggagatgggaagaagcaaatcgccccgcaatataggatccagcgccttgactcgtggactgatagtaaggaagactcagtattcatcaccacctatggattcatctttcaagttgggaatgaggaagccactgtcggcatgatcgatgataaacccaagcgcgagttactttccgctgcgatgctctgcctaggaagcgtcccaaataccggagaccttgttgagctggcaagggcctgtctcactatgatggtcacatgcaagaagagtgcaactaatactgagagaatggttttctcagtagtgcaggcaccccaagtgctgcaaagctgtagggttgtggcaaacaaatactcatcagtgaatgcagtcaagcacgtgaaagcgccagagaagatccccgggagtggaaccctagaatacaaggtgaactttgtctccttgactgtggtaccgaagaaggatgtctacaagatcccaactgcagcattgaaaatctctggctcgagcctgtacaacctcgcactcaatgtcactattgacgtggaggtagacccgaagagcccgttggtcagatccctttctaagtctgatagtggatactatgctaatctttttttgcatatcgggcttatgtccactgtagataagaagggaaagaaagtgtcatttgacaagatagagggaaagataaggagactcaatctttctgtcgggctcagtgatgtgctcggaccttctgtgcttgtgaaggcgagaggtgcacggactaagctactggcaccttttttctctagcagcgggacagcctgctatcctatagcaaatgcctctcctcaggttgctaagatactctggagtcaaactgcgcacctgcgaagtgtaaaagtcatcattcaagctggcacccaacgtgccgtcgcagtgactgctgatcatgaggttacctctactaagatagaaaagaggcacaccattgctaagtacaacccttttaaaaagtaa

SEQ ID NO: 243 - DNA, 1095 bp, Newcastle disease virus
atggactcatccaggacaatcgggctgtactttgattctgccctcccttccagcagcctgttagcattcccgatcgtcctacaagacacaggagatgggaagaagcaaatcaccccacaatacaggatccagcgtcttgactcgtggacagacagtaaggaagactcggtatttatcaccacctacggattcatcttccaaattgggaatgaagaagtcaccgtcggcatgatcaacgacaatcccaggcacgagttactttcttctgcgatgctctgcctaggaagtgtcccgaacgatggagatcttgttgaactggcgagggcctgcctcactatggtggtaacttgcaagaagagtgcgactaatactgaaagaatagtcttctcagtagtgcaggcacctcgggtgctgcaaagctgtatggttgtggcaaataggtactcatcagtgaatgcagtgaagcatgtgaaagcacccgagaagatccctgggagcggaaccctagagtataaggtgaattttgtctctttgactgtggtgccgaggaaagacgtctataggatcccaactgcagcattgaaaatatctggctcaagcctatacaatctcgcgctcaatgtcactattgatgtggaggtagacccgaagagcccgttagtcaaatccctttctaagtctgatagtggatactatgctaatctttttttgcatatcgggcttatgtccactgtagataagaagggaaagaaagtgacatttgacaagatagagggaaagataagaagactcaatctatctgtcgggctcagtgatgtgctcggaccttctgtgcttgtgaagccgagaggtgcacggactaagctactggcacctttcttctctagcagtgggacagcctgctatcctatagcaaatgcctctccccaggttgctaaaatactctggagccaaactgcgcacctgcggagtgtaaaagtcatcattcaagctggcacccaacgtgctgtcgcagtgactgctgatcatgaggttacctctaccaagatagagaagaaacacaccattgctaaatacaatcctttcaaaaagtaa

SEQ ID NO: 244 - DNA, 1241 bp, Newcastle disease virus
acgggtagaatcaaagtgccctgactgtgctaaaatggactcatccaggacaatcggactgtactttgattctgcccttccttccagcagcctgcttgctttcccgatcgtcctacaaaccacaggagatgggaagaagcaaatcaccccacaatataggatccagcgtcttgactcgtggacggacagcaaagaagattcggtatttatcaccacctacgggttcatcttccaagtcgggaatgaagaagtcactgtcggcacgatcaatgataaccctaggcaagagttactttcttctgcaatgctctgcctagggagtgtccctaatgacggagatctcgttgagctggcgagggcctgcctcactatggtggtaacgtgcaagaagagtgcaaccaatactgagagaatagtcttctcgatagtgcaggcaccccgggtgctgcaaagctgtatggttgtggcaaataggtactcatcagtgaatgcagtaaagcatgtaaaagcaccagagaagatccccgggagcggaactctagagtataaggtgaactttgtctctttgactgtggtgccgaggaaggatgtctacaggatcccaaccgcagcattgaaagtatctggctcgagcctgtacaatcttgcgctcaatgtcactattgatgtggaggtggacccgaagagcccattagtcaaatccctttccaagtccgatagtggatactatgctaatcttttcttacatatcgggcttatgtccactgtagataaaaagggaaagaaagtgacatttgacaagctggaaaggaagataagaagactcaatctatctgttgggctcagtgatgtgctcggaccttctgtgcttgtgaaggcgagaggtgcacggactaagctgttggcacctttcttctctagcagtgggacagcctgctaccctatagcaaatgcttctccccaggttgctaagatactctggagtcaaactgcgcacctgcgaagtgtaaaggtcatcattcaagcgggcacccaacgtgctgtcgcagtgaccgctgaccatgaggttacctctactaagatagagaagaggcatactattgctaaatacaaccccttcgagaaataggttgtattcctgatactattgtctgcccgctttcctgaatcattgcgacactagataatgatctgctttgattgcttatagttagtttacctgtctatccaattagaaaaaa

SEQ ID NO: 245 - DNA, 1095 bp, Newcastle disease virus
atggactcatctaggacaattgggctgtactttgattctgcccattcttctagcaacctgttagcatttccgatcgtcctacaaggcacaggagatgggaagaagcaaatcgccccgcaatataggatccagcgccttgacttgtggactgatagtaaggaggactcagtattcatcaccacctatggattcatctttcaagttgggaatgaagaagccactgtcggcatgatcgatgataaacccaagcgcgagttactttccgctgcgatgctctgcctaggaagcgtcccaaataccggagaccttattgagctggcaagggcctgtctcactatgatagtcacatgcaagaagagtgcaactaatactgagagaatggttttctcagtagtgcaggcaccccaagtgctgcaaagctgtagggttgtggcaaacaaatactcatcagtgaatgcagtcaagcacgtgaaagcgccagagaagattcccgggagtggaaccctagaatataaggtgaactttgtctccttgactgtggtaccgaagaaggatgtctacaagatcccagctgcagtattgaaggtttctggctcgagtctgtacaatcttgcgctcaatgtcactattaatgtggaggttgacccgaggagtcctttggttaaatctctgtctaagtctgacagcggatactatgctaacctcttcttgcatattggacttatgaccaccgtagataggaaggggaagaaagtgacatttgacaagctggaaaagaaaataaggagccttgatctatctgtcgggctcagtgatgtgctcgggccttccgtgttggtaaaagcaagaggtgcacggactaagcttttggcacctttcttctctagcagtgggacagcctgctatcccatagcaaatgcttctcctcaggtggccaagatactctggagtcaaaccgcgtgcctgcggagcgttaaaatcattatccaagcaggtacccaacgcgctgtcgcagtgaccgccgaccacgaggttacctctactaagctggagaaggggcacacccttgccaaatacaatccttttaagaaataa

SEQ ID NO: 246 - DNA, 1241 bp, Newcastle disease virus
acgggtagaatcaaaataccccgattgtgccaaaatggactcatccagaacaatcgggttgtactttgattctgccctcccttccagcagcctgttagcattcccgatcgtcttacaagacacaggagatgggaagaaacgaatcaccccacaatacaggatccagcgtcttgactcgtggacagacagtaaggaagactcagtatttatcaccacctacggattcatcttccaaattgggaatgaagaggtcactgttggcatgatcaacgacaatcccagacacgagttactttcctctgcaatgctctgcctaggaagtgtcccgaatgacggagatcttgttgaactggcaagggcctgcctcactatggcggtaacatgcaagaagagtgcaactaatactgagagaatagtcttctcagtagtgcaggcacctcgggtgctgcaaagctgtatggttgtggcaaataggtactcatcagtgaatgcagtgaagcatgtgaaagcacccgagaagatccctgggagcggaaccctagagtataaagtgaattttgtctctttgactgtggtgccgaggaaggatgtctacaggatcccaactgcagcattgaaaatctctggctcaagcctatacaacctcgcgctcaatgtcactattgacgtggaggtagacccgaagagcccgctagtcaaatccctttctaagtctgatagtggatactatgctaatctttttttgcatatcgggcttatgtctactgtagataggaagggaaagaaagtgacatttgacaagatagaaggaaagataagaagactcaatctatctgtcgggctcagtgatgtgctcggaccttctgtgcttgtgaaggcgagaggtgcacgaactaagctactggcaccttttttctctagcagcgggacagcctgctatcctatagcaaatgcctctcctcaggttgctaagatactctggagtcaaactgcgcacctgcggagtgtaaaggtcatcattcaagctggcacccaacgtgctgtcgcagtgactgctgatcatgaggttacctctactaagatagagaagaagcacaccattgctaagtacaatcctttcaagaagtaggttgcatctctgagactgcgagccacccactttcctaaatcatcgcgacactagataatgatctatcttgattgcttataattagttcacctgtctatctaattagaaaaaa

SEQ ID NO: 247 - DNA, 1095 bp, Newcastle disease virus
atggactcatccaggacaatcgggctgtacttcgattccacccttccttccagcaacctgttagcattcccgatcgtcctacaagacacaagagatgggaagaagcaaatcaccccgcaatataggatccagcgtcttgactcgtggacagacagtaaagaagattcggtatttatcaccacctatggattcatcttccaggttgggagtgaggaagtcactgtcggcatgatcaatgataatcccaagcacgagttactttcctctgcgatgctctgcctaggaagtgtcccgaatgatggagatcttgttgagctggcgagggcctgccttactatggtggtaacatgcaagaagagtgcgactaatactgagagaatggtcttctcggtagtgcaagcaccccgggtactgcaaagctgtacggttgtggcgaacagatactcgtcagtgaatgcagttaagcacgtgaaagtaccagagaagatccctgggagcggaaccctagagtacaaggtgaactttgtctctctgactgtggtgccgaggaaggatgtctacaggatcccaaccgcggcattgaaagtgtctggctcgagcctgtacaatcttgcgctcaatgtcactattgatgtggaggtggacccgaagagcccgttagtcaaatccctttccaagtccgacagtggatactacgctaatctcttcttgcatatcggacttatgtccactgtagataagaaggggaagaaagtgacatttgacaagctggagaggaagataaggagactcgatctatccgtcgggctcagtgatgtgctcggaccttccgtgcttgtgaaggcgagaggtgcacggactaggctgctggcaccttttttctctagcagtgggacagcctgctatcctatagcaaatgcctctcctcaggtagctaagatactctggagtcaaactgcgcgcctgcggagtgtaaaagtcatcatccaagcgggcacccaacgcgctgtcgcagtgactgctgaccatgaggttacctctactaagatagagaagaggcataccattgctaaatacaatcctttcaagaaatag

SEQ ID NO: 248 - DNA, 1095 bp, Newcastle disease virus
atggactcatccaggacaatcgggctgtactttgattctgccctcccttccagcagcctgttagcatttccgattgtcttacaagacacaggagacgggaagaagcaaatcaccccacaatacaggatccagcgccttgattcgtggacagacagtaaggaagactcggtattcatcaccacctacgggttcatctttcaaattgggaatgaagaagccactgtcggtgtgatcaatgacaatcccaagcacgagctactctcttccgcaatgctctgcttagggagtgtcccgaacgacggagatcttgttgagctggcaagagcctgcctcaccatggtggtaacttgcaagaagagtgcaactaacactgagagaatagtcttctcagtagtgcaggcacctcgggtgctgcaaagctgtatggttgtggcaaataggtactcatcagtgaatgcagtgaagcatgtgaaggcgccagaaaagatccctgggagcggaaccctagagtataaagtgaattttgtctctttgaccgtggtgccaagaagggatgtctacaggatcccaactgcagtattgaaagtgtctggctcaagcctgtacaatcttgcgctcaatgtcactattgatgtggacgtggatccgaagagcccgttagtcaaatccctttctaagtccgatagcggatactatgcgaatctttttctgcatatcgggcttatgtccactgtagataagaagggaaagaaagtgatatttgacaagatagaggaaaagataaggagactcaatctatccgtcgggctcagtgatgtgctcggaccctctgtgcttgtgaaggcgagaggtgcacggactaagttacttgctcctttcttctctagcagtgggacagcctgctatcctatagcaaatgcctctccccaggttgccaagatactctggagccaaactgcgcacttgcggagtgtgaaagtcatcattcaagccggcactcagcgtgctgtcgcagtgaccgctgatcatgaggtaacctccactaagatagagaggaggcatgccattgctaaatacaatcctttcaggaaataa

SEQ ID NO: 249 - DNA, 1095 bp, Newcastle disease virus
atggactcatctaggacaatcgggctgtactttgattctgcccttccttctagcaacctgttagcattcccgatcgtcctacaagacacaggggacgggaagaagcaaatcgccccgcaatataggatccagcgtcttgactcgtggacagacagcaaagaggactcggtgttcatcactacctatggattcatctttcaggttgggaatgaagaagccactgtcggcatgatcaatgataatcccaagcgcgagttactttccgctgcaatgctctgcctaggaagtgtcccaaatgtcggagatcttgtcgagctggcaagggcctgcctcactatggtagtaacatgcaagaagagtgcaactaacaacgagagaatggtcttctcagtagtgcaggacccccaggtgctgcaaagctgcagggttgtggcaaacaaatactcgccggtgaatgcagtcaagtacgtgaaaccgccagagaagatccctgggatcggaaccctagagtaccaggtgaactttgtctccttgcccgtggtaccgatgcaggatgtctacaagataccaactgcagcactaaaggtctctggctcgagtctgcacaatcttgcgctcaatgtcactattgatgtggaggtagacccgaagagcccgttggtcaaatctctttccaagtccgacagtggatactatgctaatctcttcttacatattgggcttatgtccactgtagataagaaggggaagaaagtgacatttgacaagctggagaggaagataaggagacttgatctatctgtcgggctcagtgacgtgctcggaccttccgtacttgtgaaggcgagaggtgcaaggactaagctgctggcacctttcttctctagcagtgggacagcctgctatcccatagcaaatgcctctcctcaggtggctaagatactctggagtcaaactgcgtgcctgcggagtgtcaaagtcattatccaagcaggtacccagcgcgctgtcgcagtgaccgctgaccatgaggttacctctactaagctggagaaggggcataccattgccaaatacaatcctttcaagaaatag

SEQ ID NO: 250 - protein, 467 aa, Homo sapiens
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAESTERESQDTVAENDDGGFSEEWEAQRDSHLGPHRSTPESRAAVQELSSSILAGEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 251 - protein, 529 aa, Influenza virus
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVLHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYIKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKD

SEQ ID NO: 252 - protein, 751 aa, CMV gB protein
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNP

SEQ ID NO: 253 - protein, 717 aa, CMV gB protein
MRPGLPSYLIILAVCLFSHLLSSRYGAEAVSEPLDKAFHLLLNTYGRPIRFLRENTTQCTYNSSLRNSTVVRENAISFNFFQSYNQYYVFHMPRCLFAGPLAEQFLNQVDLTETLERYQQRLNTYALVSKDLASYRSFSQQLKAQDSLGEQPTTVPPPIDLSIPHVWMPPQTTPHGWTESHTTSGLHRPHFNQTCILFDGHDLLFSTVTPCLHQGFYLIDELRYVKITLTEDFFVVTVSIDDDTPMLLIFGHLPRVLFKAPYQRDNFILRQTEKHELLVLVKKDQLNRHSYLKDPDFLDAALDFNYLDLSALLRNSFHRYAVDVLKSGRCQMLDRRTVEMAFAYALALFAAARQEEAGAQVSVPRALDRQAALLQIQEFMITCLSQTPPRTTLLLYPTAVDLAKRALWTPNQITDITSLVRLVYILSKQNQQHLIPQWALRQIADFALKLHKTHLASFLSAFARQELYLMGSLVHSMLVHTTERREIFIVETGLCSLAELSHFTQLLAHPHHEYLSDLYTPCSSSGRRDHSLERLTRLFPDATVPATVPAALSILSTMQPSTLETFPDLFCLPLGESFSALTVSEHVSYIVTNQYLIKGISYPVSTTVVGQSLIITQTDSQTKCELTRNMHTTHSITVALNISLENCAFCQSALLEYDDTQGVINIMYMHDSDDVLFALDPYNEVVVSSPRTHYLMLLKNGTVLEVTDVVVDATDSR

SEQ ID NO: 254 - protein, 653 aa, Ebola virus
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVSNGAKNISGQSPARTSSDPGTNTTTEDHKIMASENSSAMVQVHSQGREAAVSHLTTLATISTSPQSLTTKPGPDNSTHNTPVYKLDISEATQVEQHHRRTDNDSTASDTPSATTAAGPPKAENTNTSKSTDFLDPATTTSPQNHSETAGNNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQWIP

SEQ ID NO: 255 - protein, 528 aa, Influenza virus
  misc_feature (144)..(144): Xaa can be any naturally occurring amino acid
  misc_feature (202)..(202): Xaa can be any naturally occurring amino acid
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHXVTGVSASCSHNGKSSFYRNLLWLTGKNGLYPNLSKSYANNKEKEVLVLWGVHHPPNIXDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQ

SEQ ID NO: 256 - protein, 548 aa, Influenza B virus
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHT

SEQ ID NO: 257 - protein, 529 aa, Influenza virus
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNKSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKD

SEQ ID NO: 258 - protein, 679 aa, Human immunodeficiency virus
MRVKEIRRNYQHLWRWGTMLLGILMICSAAEKLWVTVYYGVPVWKEANTTLFCASDAKATKAEVHNVWATHACVPTDPNPQELALENVTEKFDMWKNNMVEQMHEDIISLWDQSLKPCVKLTPLCVTLTCTDYSGNNNTNITGKANTTIDDIEMKNCSFNITTGIRDKVKREYALFYKVDVVPIEKNTSYRLIHCNTSTITQACPKVSFEPIPIHYCAPAGFAILKCKDKKFNGTGLCTNVSTVQCTHGIRPVVSTQLLLNGSLAEEEVVIRSQNFTDNVKTIIVQLNESVVINCTRPNNNTRKSIHIGPGGAFYTTGQVIGNIRQAYCNISEEQWNKTLKYIVEKLREQFGNKTIIFNQSSGGDPEIVTHSFNCGGEFFYCNTSRLFNSTWNITEGSNSTAGSNKNITLPCRIKQIINMWQEVGKAMYAPPISGLIRCTSNITGLLLTRDGGHDNKTNDTEIFRPGGGNMRDNWRSELYKYKVVKIEPLGIAPTKARRRVVQRDKRAVGIGAMFLGILGAAGSTMGAASITLTVQARQLLSGIVQQQNNLLRAIEAQQHLLQLTVWGIKQLQARVLAVERYLKDQQLLGIWGCSGKLICTTNVPWNTSWSNRSLDYIWGNMTWIQWEREIDNYTDLIYTLIEESQDQQEKNELELMKLDKWDSLWSWFSITNWLWYIR

SEQ ID NO: 259 - protein, 797 aa, HSV gH protein
MGNGLWFVGVIILGAAWGQVHDWTEQTDPWFLDGLGMDRMYWRDTNTGRLWLPNTPDPQKPPRGFLAPPDELNLTTASLPLLRWYEERFCFVLVTTAEFPRDPGQLLYIPKTYLLGRPPNASLPAPTTVEPTAQPPPAVAPLKGLLHNPTASVLLRSRAWVTFSAVPDPEALTFPRGDNVATASHPSGPRDTPPPRPPVGARRHPTTELDITHLHNASTTWLATRGLLRSPGRYVYFSPSASTWPVGIWTTGELVLGCDAALVRARYGREFMGLVISMHDSPPAEVMVVPAGQTLDRVGDPADENPPGALPGPPGGPRYRVFVLGSLTRADNGSALDALRRVGGYPEEGTNYAQFLSRAYAEFFSGDAGAEQGPRPPLFWRLTGLLATSGFAFVNAAHANGAVCLSDLLGFLAHSRALAGLAARGAAGCAADSVFFNVSVLDPTARLQLEARLQHLVAEILEREQSLALHALGYQLAFVLDSPSAYDAVAPSAAHLIDALYAEFLGGRVVTTPVVHRALFYASAVLRQPFLAGVPSAVQRERARRSLLIASALCTSDVAAATNADLRTALARADHQKTLFWLPDHFSPCAASLRFDLDESVFILDALAQATRSETPVEVLAQQTHGLASTLTRWAHYNALIRAFVPEASHRCGGQSANVEPRILVPITHNASYVVTHSPLPRGIGYKLTGVDVRRPLFLTYLTATCEGSTRDIESKRLVRTQNQRDLGLVGAVFMRYTPAGEVMSVLLVDTDNTQQQIAAGPTEGAPSVFSSDVPSTALLLFPNGTVIHLLAFDTQP

SEQ ID NO: 260 - protein, 531 aa, Influenza virus
MEKIVLLLAIVSLVKSDQICIGYHANNSTEQVDTIMEKNVTVTHAQDILEKTHNGKLCDLNGVKPLILRDCSVAGWLLGNPMCDEFINVPEWSYIVEKASPANDLCYPGDFNDYEELKHLLSRTNHFEKIQIIPKSSWSNHDASSGVSSACPYHGRSSFFRNVVWLIKKNSAYPTIKRSYNNTNQEDLLVLWGIHHPNDAAEQTKLYQNPTTYISVGTSTLNQRLVPEIATRPKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNTPQRERRRKKRGLFGAIAGFIEGGWQGMVDGWYGYHHSNEQGSGYAADKESTQKAIDGVTNKVNSIIDKMNTQFEAVGREFNNLERRIENLNKQMEDGFLDVWTYNAELLVLMENERTLDFHDSNVKNLYDKVRLQLRDNAKELGNGCFEFYHKCDNECMESVKNGTYDYPQYSEEARLNREEISGVKLESMGTYQ

SEQ ID NO: 261 - protein, 523 aa, Influenza virus
METISLITILLVVTASNADKICIGHQSTNSTETVDTLTETNVPVTHAKELLHTEHNGMLCATSLGHPLILDTCTIEGLVYGNPSCDLLLGGREWSYIVERSSAVNGTCYPGNVENLEELRTLFSSASSYQRIQIFPDTTWNVTYTGTSRACSGSFYRSMRWLTQKSGFYPVQDAQYTNNRGKSILFVWGIHHPPTYTEQTNLYIRNDTTTSVTTEDLNRTFKPVIGPRPLVNGLQGRIDYYWSVLKPGQTLRVRSNGNLIAPWYGHVLSGGSHGRILKTDLKGGNCVVQCQTEKGGLNSTLPFHNISKYAFGTCPKYVRVNSLKLAVGLRNVPARSSRGLFGAIAGFIEGGWPGLVAGWYGFQHSNDQGVGMAADRDSTQKAIDKITSKVNNIVDKMNKQYEIIDHEFSEVETRLNMINNKIDDQIQDVWAYNAELLVLLENQKTLDEHDANVNNLYNKVKRALGSNAMEDGKGCFELYHKCDDQCMETIRNGTYNRRKYREESRLERQKIEGVKLESEGTYK

SEQ ID NO: 262 - protein, 531 aa, Influenza virus; identical to SEQ ID NO: 260

SEQ ID NO: 263 - protein, 490 aa, Nipah virus
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLIS

SEQ ID NO: 264 - protein, 524 aa, respiratory syncytial virus
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTN

SEQ ID NO: 265 - protein, 524 aa, respiratory syncytial virus; identical to SEQ ID NO: 264

SEQ ID NO: 266 - protein, 1193 aa, SARS virus
MFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCSFGGVSVITPGTNASSEVAVLYQDVNCTDVSTAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKEELDKYFKNHTSPDVDLGDISGINASVVNIQKEIDRLNEVAKNLNESLIDLQELGKYEQYIK

SEQ ID NO: 267 - protein, 689 aa, Varicella zoster
MFVTAVVSVSPSSFYESLQVEPTQSEDITRSAHLGDGDEIREAIHKSQDAETKPTFYVCPPTGSTIVRLEPTRTCPDYHLGKNFTEGIAVVYKENIAAYKFKATVYYKDVIVSTAWAGSSYTQITNRYADRVPIPVSEITDTIDKFGKCSSKATYVRNNHKVEAFNEDKNPQDMPLIASKYNSVGSKAWHTTNDTYMVAGTPGTYRTGTSVNCIIEEVEARSIFPYDSFGLSTGDIIYMSPFFGLRDGAYREHSNYAMDRFHQFEGYRQRDLDTRALLEPAARNFLVTPHLTVGWNWKPKRTEVCSLVKWREVEDVVRDEYAHNFRFTMKTLSTTFISETNEFNLNQIHLSQCVKEEARAIINRIYTTRYNSSHVRTGDIQTYLARGGFVVVFQPLLSNSLARLYLQELVRENTNHSPQKHPTRNTRSRRSVPVELRANRTITTTSSVEFAMLQFTYDHIQEHVNEMLARISSSWCQLQNRERALWSGLFPINPSALASTILDQRVKARILGDVISVSNCPELGSDTRIILQNSMRVSGSTTRCYSRPLISIVSLNGSGTVEGQLGTDNELIMSRDLLEPCVANHKRYFLFGHHYVYYEDYRYVREIAVHDVGMISTYVDLNLTLLKDREFMPLQVYTRDELRDTGLLDYSEIQRRNQMHSLRFYDIDKVVQYDSGTAIMQGMAQFFQG

SEQ ID NO: 268 - protein, 575 aa, Varicella zoster
MFYEALKAELVYTRAVHGFRPRANCVVLSDYIPRVACNMGTVNKPVVGVLMGFGIITGTLRITNPVRASVLRYDDFHTDEDKLDTNSVYEPYYHSDHAESSWVNRGESSRKAYDHNSPYIWPRNDYDGFLENAHEHHGVYNQGRGIDSGERLMQPTQMSAQEDLGDDTGIHVIPTLNGDDRHKIVNVDQRQYGDVFKGDLNPKPQGQRLIEVSVEENHPFTLRAPIQRIYGVRYTETWSFLPSLTCTGDAAPAIQHICLKHTTCFQDVVVDVDCAENTKEDQLAEISYRFQGKKEADQPWIVVNTSTLFDELELDPPEIEPGVLKVLRTEKQYLGVYIWNMRGSDGTSTYATFLVTWKGDEKTRNPTPAVTPQPRGAEFHMWNYHSHVFSVGDTFSLAMHLQYKIHEAPFDLLLEWLYVPIDPTCQPMRLYSTCLYHPNAPQCLSHMNSGCTFTSPHLAQRVASTVYQNCEHADNYTAYCLGISHMEPSFGLILHDGGTTLKFVDTPESLSGLYVFVVYFNGHVEAVAYTVVSTVDHFVNAIEERGFPPTAGQPPATTKPKEITPVNPGTSPLLR

SEQ ID NO: 269 - protein, 272 aa, Varicella zoster
MFLIHCLISAVIFYIQVTNALIFKGDHVSLQVNSSLTSILIPMQNDNYTEIKGQLVFIGEQLPTGTNYSGTLELLYADTVAFCFRSVQVIRYDGCPRIRTSAFISCRYKHSWHYGNSTDRISTEPDAGVMLKITKPGINDAGVYVLLVRLDHSRSTDGFILGVNVYTAGSHHNIHGVIYTSPSLQNGYSTRALFQQARLCDLPATPKGSGTSLFQHMLDLRAGKSLEDNPWLHEDVVTTETKSVVKEGIENHVYPTDMSTLPEKSLNDPPEN

SEQ ID NO: 270 - protein, 437 aa, Influenza virus
VTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 271 - protein, 210 aa, Metapneumovirus
ESNEALSLCRIQGTPAPRDNKTNTENATKETTLHTTTTTRDPEVRETKTTKPQANEGATNPSRNLTTKGDKHQTTRATTEAELEKQSKQTTEPGTSTQKHTPARPSSKSPTTTQATAQPTTPTAPKASTAPKNRQATTKKTETDTTTASRARNTNNPTETATTTPKATTETGKGKEGPTQHTTKEQPETTARETTTPQPRRTAGASPRAS

SEQ ID NO: 272 - protein, 433 aa, Influenza virus
SDILLKFPSAEITAPTMPLDCANASNVQAVNRSATKGVTLLLPEPEWTYPRLSCPGSTFQEALLISPHRFGETKGNSAPLIIREPFIACGPKECKHFALTHYAAQPGGHYNGTRGDRNKLRHLISVKLGKIPTVENSIFHMAAWSGSACHDGKEWTYIGVDGPDNNALLKIEYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVSMEEPGWYSFGFEIKDKKCDVPCIGIEMVHDGGKETWHSAATAIYCLMGSGQLLWDTVTGVDMAL

SEQ ID NO: 273 - protein, 168 aa, Human metapneumovirus
NYTIQKTSSESEHHTSSPPTESNKEASTISTDNPDINPNSQHPTQQSTENPTLNPAASVSPSETEPASTPDTTNRLSSVDRSTAQPSESRTKTKPTVHTRNNPSTASSTQSPPRATTKAIRRATTFRMSSTGKRPTTTSVQSDSSTTTQNHEETGSANPQASVSTMQN

SEQ ID NO: 274 - protein, 250 aa, respiratory syncytial virus
NHKVTLTTVTVQTIKNHTEKNITTYLTQVSPERVSPSKQPTTTPPIHTNSATISPNTKSETHHTTAQTKGRTTTPTQNNKPSTKPRPKNPPKKPKDDYHFEVFNFVPCSICGNNQLCKSICKTIPSNKPKKKPTIKPTNKPPTKTTNKRDSKTLAKTLKKETTINPTKKPTPKTTERDTSTLQSIVLDTTTSKHTERDTSTSQSIVLDTTTSKHTIQQQSLHSTTPENTPNSTQTPTASEPSTSNSNQKL

SEQ ID NO: 275 - protein, 415 aa, Influenza virus
SHSIQTGNQHQAEPISNTNFLTEKAVASVTLAGNSSLCPISGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 276 - protein, 438 aa, Influenza virus
NTVIHEKIGNHQTVIHPTITTPAVPNCSDTIITYNNTVINNITTTIITEAERLFKPPLPLCPFRGFFPFHKDNAIRLGENKDVIVTREPYVSCDNDNCWSFALAQGALLGTKHSNGTIKDRTPYRSLIRFPIGTAPVLGNYKEICIAWSSSSCFDGKEWMHVCMTGNDNDASAQIIYAGRMTDSIKSWRKDILRTQESECQCIGGTCVVAVTDGPAANSADHRVYWIREGRIVKYENVPKTKIQHLEECSCYVDIDVYCICRDNWKGSNRPWMRINNETILETGYVCSKFHSDTPRPADPSTVSCDSPSNINGGPGVKGFGFKAGNDVWLGRTVSTSGRSGFEIIKVTDGWINSPNHAKSVTQTLVSNNDWSGYSGSFIVKTKGCFQPCFYVELIRGRPNKNDDVSWTSNSIVTFCGLDNEPGSGNWPDGSNIGFMPK

SEQ ID NO: 277 - protein, 432 aa, Influenza virus
KQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 278 - protein, 559 aa, Measles virus
RLHRAAIYTAENHKSLSTNLDVTNSIEHQVKDVLTPLFKIIGDEVGLRTPQRFTDLVKFISDKIKFLNPDREYDFRDLTWCINPPERIKLDYDQYCADVAAEELMNALVNSTLLEARATNQFLAVSKGNCSGPTTIRGQFSNMSLSLLDLYLSRGYNVSSIVTMTSQGMYGGTYLVEKPNLSSKGSELSQLSMHRVFEVGVIRNPGLGAPVFHMTNYFEQPVSNDFSNCMVALGELKFAALCHREDSITIPYQGSGKGVSFQLVKLGVWKSPTDMRSWVPLSTDDPVIDRLYLSSHRGVIADNQAKWAVPTTRTDDKLRMETCFQQACKGKNQALCENPEWAPLKDNRIPSYGVLSVNLSLTVELKIKIASGFGPLITHGSGMDLYKTNHNNVYWLTIPPMKNLALGVINTLEWIPRFKVSPNLFTVPIKEAGEDCHAPTYLPAEVDGDVKLSSNLVILPGQDLQYVLATYDTSRVEHAVVYYVYSPSRSFSYFYPFRLPIKGVPIELQVECFTWDKKLWCRHFCVLADSESGGHITHSGMVGMGVSCTVTREDGTNRR

SEQ ID NO: 279 - protein, 529 aa, Mumps virus
ELIRMINDQGLSNQLSSITDKIRESAAMIASAVGVMNQVIHGVTVSLPLQIEGNQNQLLSTLATICTNRNQVSNCSTNIPLVNDLRFINGINKFIIEDYATHDFSIGHPLNMPSFIPTATSPNGCTRIPSFSLGKTHWCYTHNVINANCKDHTSSNQYVSMGILVQTASGYPMFKTLKIQYLSDGLNRKSCSIATVPDGCAMYCYVSTQLETDDYAGSSPPTQKLTLLFYNDTIKERTISPSGLEGNWATLVPGVGSGIYFENKLIFPAYGGVLPNSTLGVKSAREFFRPVNPYNPCSGPPQELDQRALRSYFPSYFSSRRVQSAFLVCAWNQILVTNCELVVPSNNQTLMGAEGRVLLINNRLLYYQRSTSWWPYELLYEISFTFTNSGQSSVNMSWIPIYSFTRPGLGKCSGENICPTVCVSGVYLDPWPLTPYSHQSGINRNFYFTGALLNSSTTRVNPTLYVSALNNLKVLAPYGTQGLFASYTTTTCFQDTGDASVYCVYIMELASNIVGEFQILPVLARLTIT

SEQ ID NO: 280 - protein, 531 aa, Nipah virus
NYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 281 - protein, 481 aa, Parainfluenza virus
KIDSIETVIFSALKDMHTGSMSNTNCTPGNLLLHDAAYINGINKFLVLKSYNGTPKYGPLLNIPSFIPSATSPNGCTRIPSFSLIKTHWCYTHNVMLGDCLDFTTSNQYLAMGIIQQSAAAFPIFRTMKTIYLSDGINRKSCSVTAIPGGCVLYCYVATRSEKEDYATTDLAELRLAFYYYNDTFIERVISLPNTTGQWATINPAVGSGIYHLGFILFPVYGGLISGTPSYNKQSSRYFIPKHPNITCAGNSSEQAAAARSSYVIRYHSNRLIQSAVLICPLSDMHTARCNLVMFNNSQVMMGAEGRLYVIDNNLYYYQRSSSWWSASLFYRINTDFSKGIPPIIEAQWVPSYQVPRPGVMPCNATSFCPANCITGVYADVWPLNDPEPTSQNALNPNYRFAGAFLRNESNRTNPTFYTASASALLNTTGFNNTNHKAAYTSSTCFKNTGTQKIYCLIIIEMGSSLLGEFQIIPFLRELIP

SEQ ID NO: 282 - protein, 519 aa, Parainfluenza virus
DLIIKQDTCMKTNIMTVSSMNESAKIIKETITELIRQEVISRTINIQSSVQSGIPILLNKQSRDLTQLIEKSCNRQELAQICENTIAIHHADGISPLDPHDFWRCPVGEPLLSNNPNISLLPGPSLLSGSTTISGCVRLPSLSIGDAIYAYSSNLITQGCADIGKSYQVLQLGYISLNSDMYPDLNPVISHTYDINDNRKSCSVIAAGTRGYQLCSLPTVNETTDYSSEGIEDLVFDILDLKGKTKSHRYKNEDITFDHPFSAMYPSVGSGIKIENTLIFLGYGGLTTPLQGDTKCVINRCTNVNQSVCNDALKITWLKKRQVVNVLIRINNYLSDRPKIVVETIPITQNYLGAEGRLLKLGKKIYIYTRSSGWHSNLQIGSLDINNPMTIKWAPHEVLSRPGNQDCNWYNRCPRECISGVYTDAYPLSPDAVNVATTTLYANTSRVNPTIMYSNTSEIINMLRLKNVQLEAAYTTTSCITHFGKGYCFHIVEINQASLNTLQPMLFKTSIPKICKITS

SEQ ID NO: 283 - protein, 327 aa, Vaccinia virus
DIENEITEFFNKMRDTLPAKDSKWLNPACMFGGTMNDIAALGEPFSAKCPPIEDSLLSHRYKDYVVKWERLEKNRRRQVSNKRVKHGDLWIANYTSKFSNRRYLCTVTTKNGDCVQGIVRSHIKKPPSCIPKTYELGTHDKYGIDLYCGILYAKHYNNITWYKDNKEINIDDIKYSQTGKKLIIHNPELEDSGRYNCYVHYDDVRIKNDIVVSRCKILTVIPSQDHRFKLILDPKINVTIGEPANITCTAVSTSLLIDDVLIEWENPSGWLIGFDFDVYSVLTSRGGITEATLYFENVTEEYIGNTYKCRGHNYYFEKTLTTTVVLE

SEQ ID NO: 284 - protein, 104 aa, prion
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSK

SEQ ID NO: 285 - protein, 97 aa, prion
SRPIIHFGSDYEDRYYRENMHRYPNQVYYRPMDEYSNQNNFVHDCVNITIKQHTVTTTTKGENFTETDVKMMERVVEQMCITQYERESQAYYQRGSS

SEQ ID NO: 286 - protein, 15 aa, Glut-1
EEFYNQTWVHRYGES

SEQ ID NO: 287 - protein, 9 aa, Glut-1
FEKAGVQQP

SEQ ID NO: 288 - protein, 7 aa, Glut-1
EQLCGPY

SEQ ID NO: 289 - protein, 9 aa, LMP2A
SSYAAAQRK

SEQ ID NO: 290 - protein, 14 aa, LMP2A
RRRWRRLTVCGGIM

SEQ ID NO: 291 - protein, 28 aa, Homo sapiens
TFGLVFYFATDYLVQPFMDQLAFHQFYI

SEQ ID NO: 292 - protein, 180 aa, Hepatitis B virus
MGLSWTVPLEWGKNLSTSNPLGFLPDHQLDPAFRANTNNPDWDFNPKKDPWPEANKVGVGAYGPGFTPPHGGLLGWSPQSQGTLTTLPADPPPASTNRQSGRQPTPISPPLRDSHPQAMQWNSTAFHQALQNPKVRGLYFPAGGSSSGIVNPVPTIASHISSIFSRIGDPAPNMENITSG

SEQ ID NO: 293 - protein, 12 aa, Artificial Sequence
  Synthetic
VGVDPKSPLVKS

SEQ ID NO: 294 - protein, 12 aa, Artificial Sequence
  Synthetic
DSGYYANLFLHI

SEQ ID NO: 295 - protein, 12 aa, Artificial Sequence
  Synthetic
VGVDAKSALVKS

SEQ ID NO: 296 - protein, 12 aa, Artificial Sequence
  Synthetic
DSGYYANLFLHI

SEQ ID NO: 297 - protein, 12 aa, Artificial Sequence
  Synthetic
VGVDPKSPLVKS

SEQ ID NO: 298 - protein, 12 aa, Artificial Sequence
  Synthetic
DSGYAANAFLHI

SEQ ID NO: 299 - protein, 12 aa, Artificial Sequence
  Synthetic
VGVDPKSPLVKS

SEQ ID NO: 300 - protein, 12 aa, Artificial Sequence
  Synthetic
DSGYYPDLFLHI

SEQ ID NO: 301 - protein, 12 aa, Artificial Sequence
  Synthetic
VGVDPKSPLVKS

SEQ ID NO: 302 - protein, 12 aa, Artificial Sequence
  Synthetic
DSGYPTAPFLHI

SEQ ID NO: 303 - protein, 32 aa, Newcastle disease virus
TSTSALITYIALTAISLVCGILSLVLACYLMY

SEQ ID NO: 304 - protein, 32 aa, Newcastle disease virus
TSTSALITYIVLTVISLVCGILSLVLACYLMY

SEQ ID NO: 305 - protein, 32 aa, Newcastle disease virus; identical to SEQ ID NO: 304

SEQ ID NO: 306 - protein, 32 aa, Newcastle disease virus
TSTSALITYIVLTIISLVCGILSLILAFYLMY

SEQ ID NO: 307 - protein, 32 aa, Newcastle disease virus; identical to SEQ ID NO: 306

SEQ ID NO: 308 - protein, 32 aa, Newcastle disease virus
TSTSALITYIVLTIISLVCGILSLVLAFYLMY

SEQ ID NO: 309 - protein, 32 aa, Newcastle disease virus
TSTSALITYIFLTVISLVCGILSLVLACYLMY

SEQ ID NO: 310 - protein, 32 aa, Newcastle disease virus
TSTSALITYIVLTVISLVCGILSLVLACYLMH

SEQ ID NO: 311 - protein, 32 aa, Newcastle disease virus
TSTSALITYIVLTVISLVCGVLSLVLAFYLMY

SEQ ID NO: 312 - protein, 32 aa, Newcastle disease virus; identical to SEQ ID NO: 311

SEQ ID NO: 313 - protein, 32 aa, Newcastle disease virus
TSTSALITYIVLAVVSLAFGVISLVLACYLMY

SEQ ID NO: 314 - protein, 32 aa, Newcastle disease virus
TSTSALITYIVLAVISLAFGVISLVLACYLMY

SEQ ID NO: 315 - protein, 32 aa, Newcastle disease virus
TSTSALITYIVLTVISLVFGALSLGLACYLMY

SEQ ID NO: 316 - protein, 32 aa, Newcastle disease virus
TSTSALITYIVLTIISLVFGILSLVLACYLMY

SEQ ID NO: 317 - protein, 32 aa, Newcastle disease virus
INTSALITYIVLTVISLVFSALGLILGCYLMY

SEQ ID NO: 318 - protein, 26 aa, Newcastle disease virus
KQKAQQKTLLWLGNNTLGQMRATTKM

SEQ ID NO: 319 - protein, 26 aa, Newcastle disease virus
KQKAQQKTLLWLGNNTLGQMRATTKM

SEQ ID NO: 320 - protein, 26 aa, Newcastle disease virus
KQKAQQKTLLWLGNNTLGQMRATTKM

SEQ ID NO: 321 - protein, 26 aa, Newcastle disease virus
KQKAQQKTLLWLGNNTLGQMRATTKM

SEQ ID NO: 322 - protein, 26 aa, Newcastle disease virus
KQKAQQKTLLWLGNNTLGQMRATTKM

SEQ ID NO: 323 - protein, 26 aa, Newcastle disease virus
KQKAQQKTLLWLGNNTLGQMRATTKM

SEQ ID NO: 324 - protein, 26 aa, Newcastle disease virus
KQKAQQKTLLWLGNNTLGQMRATTKM

SEQ ID NO: 325 - protein, 26 aa, Newcastle disease virus
KQKAQQKTLLWLGNNTLGQMRATTKA

SEQ ID NO: 326 - protein, 26 aa, Newcastle disease virus
KQKAQQKTLLWLGNNTLGQMRATTKI

SEQ ID NO: 327 - protein, 26 aa, Newcastle disease virus
KQKAQQKTLLWLGNNTLGQMRATTKI

SEQ ID NO: 328 - protein, 26 aa, Newcastle disease virus
KQKAQQKTLLWLGNNTLDQMRATTRT

SEQ ID NO: 329 - protein, 26 aa, Newcastle disease virus
KQKAQQKTLLWLGNNTLDQMRATTRT

SEQ ID NO: 330 - protein, 26 aa, Newcastle disease virus
KQKAQQKTLLWLGNNTLDQMRATTRA

SEQ ID NO: 331 - protein, 24 aa, Newcastle disease virus
KQKAQQKTLLWLGNNTLDQMRATT

SEQ ID NO: 332 - protein, 24 aa, Newcastle disease virus
KQKAQQKTLLWLGNNTLDQMRATT

SEQ ID NO: 333 - protein, 26 aa, Newcastle disease virus
MNRAVCQVALENDEREAKNTWRLVFR

SEQ ID NO: 334 - protein, 26 aa, Newcastle disease virus
MNRAVCQVALENDEREAKNTWRLVFR

SEQ ID NO: 335 - protein, 26 aa, Newcastle disease virus
MDRAVSQVALENDEREAKNTWRLVFR

SEQ ID NO: 336 - protein, 26 aa, Newcastle disease virus
MDRAVSQVALENDEREAKNTWRLVFR

SEQ ID NO: 337 - protein, 26 aa, Newcastle disease virus
MDRAVSQVALENDEREAKNTWRLIFR

SEQ ID NO: 338 - protein, 26 aa, Newcastle disease virus
MDRAVSQVALENDEREAKNTWRLIFR

SEQ ID NO: 339 - protein, 26 aa, Newcastle disease virus
MDRAVSQVALENDEREAKNTWRLIFR

SEQ ID NO: 340 - protein, 26 aa, Newcastle disease virus
MDRAVSQVALENDEREAKNTWRLVFR

SEQ ID NO: 341 - protein, 26 aa, Newcastle disease virus
MDRTVNQVALENDEREAKNTWRLVFR

SEQ ID NO: 342 - protein, 26 aa, Newcastle disease virus
MDRAVSRVALENEEREAKNTWRFVFR

SEQ ID NO: 343 - protein, 26 aa, Newcastle disease virus
MDLPVGRVALENEEREAKNTWRFVFR

SEQ ID NO: 344 - protein, 26 aa, Newcastle disease virus
MDRAVNRVVLENEEREAKNTWRLVFR

SEQ ID NO: 345 - protein, 26 aa, Newcastle disease virus
MDRAVSRVVLENEEREAKNTWRFVFR

SEQ ID NO: 346 - protein, 25 aa, Newcastle disease virus
MDRAVNRVVLENEEREAKNTWRLVF

SEQ ID NO: 347 - protein, 26 aa, Newcastle disease virus
MDRAVNRVVLENEEREAKNTWRLVFR

SEQ ID NO: 348 - protein, 26 aa, Newcastle disease virus
MDRVVSRVVLENEEREAKNTWRLVFR

SEQ ID NO: 349 - protein, 26 aa, Newcastle disease virus
MDHTVNRVVLENEEREAKNTWRSVFR

SEQ ID NO: 350 - protein, 26 aa, Newcastle disease virus
MDRVVSRVVLENEEREAKNTWRLVFR

SEQ ID NO: 351 - protein, 26 aa, Newcastle disease virus
MDRVVSRVVLENEEREAKNTWRLVFR

SEQ ID NO: 352 - protein, 22 aa, Newcastle disease virus
IAILLLTVMTLAISAAALAYSM

SEQ ID NO: 353 - protein, 22 aa, Newcastle disease virus
IAILLLTVMTLAISAAALAYSM

SEQ ID NO: 354 - protein, 22 aa, Newcastle disease virus
IAILLSTVVTLAISAAALAYSM

SEQ ID NO: 355 - protein, 22 aa, Newcastle disease virus
IAILFLTVVTLAISAAALAYSM

SEQ ID NO: 356 - protein, 22 aa, Newcastle disease virus
IAILFLTVVTLAISVASLLYSM

SEQ ID NO: 357 - protein, 22 aa, Newcastle disease virus
IAILFLTVVTLAISVASLLYSM

SEQ ID NO: 358 - protein, 22 aa, Newcastle disease virus
IAILLLTVVTLATSVASLVYSM

SEQ ID NO: 359 - protein, 22 aa, Newcastle disease virus
IAILLLTVVTLAISAAALAYSM

SEQ ID NO: 360 - protein, 22 aa, Newcastle disease virus
IATLLLIVMTLAFSAAALAYSM

SEQ ID NO: 361 - protein, 22 aa, Newcastle disease virus
IAILLLIVITLAISAAALVYSM

SEQ ID NO: 362 - protein, 22 aa, Newcastle disease virus
IAIFLLIVITLAISAAALVYSM

SEQ ID NO: 363 - protein, 22 aa, Newcastle disease virus
IAVLLLMVMTLAISAAALVYSM

SEQ ID NO: 364 - protein, 22 aa, Newcastle disease virus
IAVLLLIVMTLAISAAALVYSM

SEQ ID NO: 365 - protein, 26 aa, Newcastle disease virus
IAVLLLMVMTLAISAAALAYSTGAST

SEQ ID NO: 366 - protein, 26 aa, Newcastle disease virus
IAVLLLMVMTLAISSAALAYSTGAST

SEQ ID NO: 367 - protein, 26 aa, Newcastle disease virus
IAVLLLIVMTLAISAAALVYSMGAIM

SEQ ID NO: 368 - protein, 26 aa, Newcastle disease virus
TTVLLLMVMTLAISIAALVYIMGAST

SEQ ID NO: 369 - protein, 22 aa, Newcastle disease virus
IAVLSLVVMTLAISVATLVYSM

SEQ ID NO: 370 - protein, 22 aa, Newcastle disease virus
IAVLSLIVMTLAISVAALVYSM

SEQ ID NO: 371 - protein, 11 aa, Newcastle disease virus
TSTSALITYIA

SEQ ID NO: 372 - protein, 9 aa, Influenza virus HA
GYKDVILWF

SEQ ID NO: 373 - protein, 10 aa, Artificial Sequence
  Synthetic
GYKDLITYIA

SEQ ID NO: 374 - protein, 13 aa, Artificial Sequence
  Synthetic
GYKDGGGLITYIA

SEQ ID NO: 375 - protein, 12 aa, Artificial Sequence
  Synthetic
GYKDSALITYIA

SEQ ID NO: 376 - protein, 11 aa, Newcastle disease virus
ALAYSMEASTP

SEQ ID NO: 377 - protein, 11 aa, Influenza NA
ILITTVTLHFK

SEQ ID NO: 378 - protein, 11 aa, Artificial Sequence
  Synthetic
ALAYSVTLHFK

SEQ ID NO: 379 - protein, 12 aa, Newcastle disease virus
CYLMYKQKAQQK

SEQ ID NO: 380 - protein, 13 aa, Influenza virus HA
LGFIMYACQKGNI

SEQ ID NO: 381 - protein, 13 aa, Artificial Sequence
  Synthetic
LGFIMYKQKAQQK

SEQ ID NO: 382 - protein, 11 aa, Newcastle disease virus
RLVFRIAILLL

SEQ ID NO: 383 - protein, 11 aa, Influenza virus NA
NPNQKIITIGS

SEQ ID NO: 384 - protein, 11 aa, Artificial Sequence
  Synthetic
RLVFRIITIGS

I claim:

1. A non-infectious, replication incompetent, recombinant virus-like particle (VLP) comprising, in operable combination:
    a) Newcastle disease virus (NDV) matrix (M) protein,
    b) NDV nucleocapsid (NP) protein,
    c) a first chimeric protein comprising NDV haemagglutinin-neuraminidase (HN) protein transmembrane domain (TM) protein flanked by Newcastle Disease Virus (NDV) HN protein cytoplasmic domain (CT) protein and by a first protein sequence that comprises a first copy of a heterologous protein of interest, and
    d) a second chimeric protein comprising NDV fusion (F) protein transmembrane domain (TM) protein flanked by NDV F protein cytoplasmic domain (CT) protein and by a second protein sequence that comprises a second copy of said heterologous protein of interest,
wherein said VLP lacks NDV RNA.

2. The recombinant virus-like particle (VLP) of claim 1, wherein said protein of interest comprises an ectodomain of a membrane protein.

3. The recombinant virus-like particle (VLP) of claim 1, wherein said virus-like particle (VLP) further comprises Newcastle Disease Virus fusion (F) protein.

4. The recombinant virus-like particle (VLP) of claim 1, wherein said virus-like particle (VLP) further comprises Newcastle Disease Virus heamagglutinin-neuraminidase (HN) protein.

5. The recombinant virus-like particle (VLP) of claim 1, wherein said virus-like particle (VLP) is purified.

6. The recombinant virus-like particle (VLP) of claim 1, wherein said virus-like particle (VLP) is immunogenic.

7. A vaccine comprising the virus-like particle (VLP) of claim 1.

8. The vaccine of claim 7, further comprising an adjuvant.

9. A non-infectious, replication incompetent virus-like particle (VLP) produced by a method comprising:
    a) providing an expression vector comprising, in operable combination:
        1) a first nucleic acid sequence encoding a Newcastle Disease Virus transmembrane domain (TM) protein,
        2) a second nucleic acid sequence encoding Newcastle Disease Virus cytoplasmic domain (CT) protein,
        3) a third nucleic acid sequence encoding a protein of interest, wherein said first nucleic acid sequence is flanked by said second and third nucleic acid sequences, and
        4) a fourth nucleic acid sequence encoding Newcastle Disease Virus matrix (M) protein, b) providing a host cell, and
c) transfecting said host cell with said vector to produce a virus-like particle (VLP) comprising said protein of interest, wherein said VLP lacks NDV RNA.

10. The recombinant virus-like particle (VLP) of claim 1, wherein said VLP further comprises Newcastle Disease Virus fusion (F) protein.

11. The recombinant virus-like particle (VLP) of claim 1, wherein said VLP further comprises Newcastle Disease Virus heamagglutinin-neuraminidase (HN) protein.

12. The recombinant VLP of claim 1, wherein said VLP further comprises an ectodomain sequence of RSV G protein.

13. A non-infectious, replication incompetent, recombinant virus-like particle (VLP) comprising, in operable combination:
a) Newcastle disease virus (NDV) matrix (M) protein,
b) NDV nucleocapsid (NP) protein, and
c) NDV haemagglutinin-neuraminidase (HN) protein transmembrane domain (TM) protein flanked by Newcastle Disease Virus (NDV) HN cytoplasmic domain (CT) protein and by a protein of interest that comprises an ectodomain sequence of RSV G protein, wherein said VLP lacks NDV RNA.

14. The recombinant virus-like particle (VLP) of claim 12, wherein said protein of interest comprises an ectodomain of a membrane protein.

15. The recombinant virus-like particle (VLP) of claim 14, wherein said virus-like particle (VLP) further comprises Newcastle Disease Virus fusion (F) protein.

16. The recombinant virus-like particle (VLP) of claim 14, wherein said virus-like particle (VLP) further comprises Newcastle Disease Virus haemagglutinin-neuraminidase (HN) protein.

17. The recombinant virus-like particle (VLP) of claim 13, wherein said virus-like particle (VLP) is purified.

18. The recombinant virus-like particle (VLP) of claim 13, wherein said virus-like particle (VLP) is immunogenic.

19. A vaccine comprising the virus-like particle (VLP) of claim 13.

20. The vaccine of claim 19, further comprising an adjuvant.

21. The recombinant virus-like particle (VLP) of claim 13, wherein said VLP further comprises Newcastle Disease Virus fusion (F) protein.

22. The recombinant virus-like particle (VLP) of claim 13, wherein said VLP further comprises Newcastle Disease Virus haemagglutinin-neuraminidase (HN) protein.

23. The recombinant VLP of claim 13, wherein said VLP further comprises an ectodomain sequence of RSV G protein.

* * * * *